United States Patent 7,638,282 (GENES OF AN OTITIS MEDIA ISOLATE OF NONTYPEABLE HAEMOPHILUS INFLUENZAE) - sequence listing, part 2

SEQ ID NO: 684 - DNA, 417576 bp, H. influenzae
  misc_feature (93603)..(93603): n is a, c, g, or t
  misc_feature (93620)..(93620): n is a, c, g, or t
  misc_feature (93622)..(93625): n is a, c, g, or t
  misc_feature (138581)..(138581): n is a, c, g, or t
taattttactgatttatctatcccctcaatgtaccttaacactgcaatataaaaataaaccgtaccaggaggagatatgaaagctcgttttaaagaatggcttattagtttaaatgaaatagcaatgaatgaattaggaattgatgaaatgcttactcatcttgatgatgaactgaacatcattaacggaaatgaatgtgaacaggagattttaaataatttaatacaaatctttaaaaatagtgaataccactaaaaaaataagcgggaaaatcccgcttattttatctctatttacgcttatgaagctttcatactgcgacgttcaaagttttgagttgcactacccgctttacagctcaccgtatccattttactgccattggtgatataaagcattggctcttcaatactgttactattgtgtggttgcacaaattgaatcgtgtaacttgtgccattatttctcatttctaatgagctagtaataaatcctgaaccagtagctacataagaatcctgattagcaaaaacttgttttaccggatttttaaaagaaacctggccataagtgaattcataatctgaaccattttttgttacagacaccgggcttccgttctctgctgtacaagaaaaaatattattagctgcaaaagctggcgttgcaaacatagctaccgctccaatagtgagtaattttttcataaaaatatcctttatttattttcctaaaatgtaatctgcttcttggttacgacgtttagcatttacaccattattattgttttgacgatttcttactgcatttgctagtgcgttcatatcgcctgattgcgcagatgcctgggctgcagcaatcacatcttttgttaatgagccatagttataggcataagatgttaatgcggcttgggcatttggcggtaacttatcccatgttgaagatgatacgttatttctcgctctatttgcaaattcttgtgttcgacgtgctaaatcacgctctgcgtcagcgcgactaactacagtatctttcgttactttgacaattgtaccatccgcttttgtgatagtatctgaaccatatccagtgcgataagcattgacatcccaatatgctttatcactaaacccttcaaattttttcaacaaccctgtagcttgatcaagtgcagtccctttaattgctggaactgatgaataagaagtgttacctctactatttccggatgtaccgccagtcccggtgtaagacagggagtttgacatctgaggcacttctaaagtgacattgttacgaggaatattgatattgtcagcatctgccaattcagcagcattgctattcgtaccattagctaaatcgctaatccgtttatctacactgtcacgtgtaacatttccggttccagtgttatattcacgtagctctttattttgtaggattgcaactgcggaattcccggtaagtgatttttgtagatcaatctccattctaatttgacctatttctcggtcaattaaagtgaggatcttttctaactcttcttgagcatctttattgttggccacatttggctcacgcatacccgttaaaacagctcgacgtgcaagaagcattttctccattgttttagctacagcaatttcactggctaaacgctgccctaatacttgagcatcgggatcttctcgtaaagactcaattaagccacgagttacaggaactgttgtagaacttaattctgcaagtacttcaacggaaggagtgctcatgttaagcgctttttgtaattgagttaccgtcttaatattttctttttcaatttcaggtgttaaaccaacaccagctcgagagctactagcagtaccacaatctgttttacaagtagttaattgcttctcaccgatcacattcgttaaccaatctgtcatatctttaggattatcccaagtttgacaaagtaatccgctacaactactaccggagattcgacctgattctaatacattacgcttgttttgcatgttgtagccagcttttgcaacatcctcaacaattttgattggttcttgtccttggccaccgcgttttttacccccgacccactctttaccttccttaccttgagattcctcaagtctctttttagctcgagtagcatctggttcagttgaagtaatgtctttaaaggattccatatccgaactttgagaccaacgaccatttaaagttgcgtctgcaagcttcttagacatttcttcacagctggtttttaagctattaaaatcaattttaccttgatataaaccattcgtaagaatatcgtataactgaggatttgctcgttgaataaccattgcaggtaaactcgccacagctcctgtggctgattcgataacgttactataaagatctttaaatccttcagttaaaccatttaactgatttttaatactcgtcttaatgtcaaaattaccgcacatcaagttagctttccaaccaatcccaaattcagctgcaggaatcgtacctcgactcgggggagccatataacctacaccgcccccaatttgataaaacaccatatcagacaaaatagaatcggctttattaaatccaaacggattactattagaagctgatactggcatggttgaggataagattgcgcacgatatagcaatataagatgctttcagtgcatgatttaatttcatactcaattcctttattaattagaccaatcaatactatacaaaaatgtttgtccgcgttttttacagcacttgtaagggcgccataatgcccaggcataactaccattttcagatagcatacttggcgggttatcagggaaaatagcacaagactgtgaagtaaccgggtgaagctgttgccatttatgtgtcttttcatccccttctttcactggagggggaaaccactcaccattcgattgattatcttttttcgcaatcggtatatatacatgtggttggaaagtatttgtcacaacatccgctactcgatgcgctgttacagctgaagctttatagtcatgaacttgtgttactgtacccgctcgtggataaatatttccccaagtgtctccatttgctctaatttctctcatacctggaataagcgcttcaggataaaccatttccggaacaccaaatcgccacgctaaaaagtccaaaccactcaagtaataaggcacaaaaggcgttgtctgacttttgcagtaataccctgtactattaagcatttgactaatcgctccctgcggatgaccgattacatcaacatttttaaatgttgcttgcgtatagtctttgtgtggtgattgataatctccaccttttaccccattgctaaggaaattcatttccacccaaggattttgagcctgatggttataacttgaaaccactacctcgggaatatagtgttttattttcgtagatgtccggattttacagccgaattttgtacaaaatagccaaaaacaagtaccaacgaccttataatctaaacaacttgtcgaagcgcttgatgccataatcgatgcagtgtttaaagaagattgaccggactccgaagcttgtcctgaaatactggtcaacgcaattgcaatacaaagcccggataatgtcatttttttcaatttcatcttgtcccctcttttgtaatctctcgttgccataaacttaatgcctgagcaatattggtttcaccatatatgacactatcctcttttcccggatattgaaataaaactgcaggcaccttcttgattccattttgccaaccacttataaggccctgataagaacgctttaattgctcttcagactgtttccattcagcagactgaaaaatctgagatgcttgctgagctgctacactaggattcgcactcaatcgctgactaatcaaattttcccattgctcaacttgatcaagtaaatacacctggcttgcaagctctgcgtgaagaattggataatcttgtgttgaataaacagtaattatgggattaggcccctgggcgaacactgatagtggtaacaaaccgaaaagaaacagtgatttttttatagacataaccatcccttacgatgaaattggatagttgaaacattaacgaaatgacaggggggaatatataaaaaattctttttgattttgagataaattctccatttccaaaaaacaatttttaatagagattcgacagccttattaagtatgattggacttgataagtcgctgtgcaaacagctcttataagttgcacgattcttgagaagcaacgccttgccttagtgcaagtagaatcatagccaaaatgttatccagcattctgaaaggatactctacgcaatcgtaggaatgccaccttaaagaccttccgagggaaaatgattcccttcgggcatgtcatttttccaaggaattttttatttcacattaggagaatgactatgtcctcatccactcaattggaacactatgatgttccatcaagtaaccctcttgaaactccaacattttcatttcgtgtgggaaaacacttgggccgttttttcgttgcagctaaaaacaaagcaaccgataaatacaaacaagtgacatctggtatcaatcaaagcattgaagacgaagaagctcgtcggctttgcgaattacaaatgatgctagatagccaagcggaagaatatgaggcaattattgatgatgtgcaaagaacgtggttaaaacgaacaacgttatttagcattttatttttgattgtcggtattgttggtacagtgggtactctttactaccttatgcattaacattgcataagctattcattttcaaccctaaggggaatttttacccttagaggtaaaggtttcccttgctgtaggagaaaacttatgaaagtgacattacataacagttgtttagcttatttagccaaacataatgactcagaatctctaatagaggaagttcgcactcaagcattaaatgcctgggaaaatcgaggaaaagatgtatcttctactcgtattatggtgaatatccctagtcaatacggacagaaatatcacttctttacagtttcgccatacgcaaaccgtaaagatttgttaagtgtaagggggtaaacatgattaagcgtttactcaagcttgttagttccaattgggacaaaaaaacaatgctgctggtttctgaagattttcgtaaaatcggcacttacatcttaggtattgcgtttgtcgcaatgtttgttcagaatgacaatattccgctacttcttgccattatcattatgatatttggcggaatagcttggttctgtggtgtgttgttagctaaatattgcaacaacttaatggagacagacggagcgtaacgtatgaatattacgttaaactggaatgggttcctctttgcaattgtctttgtactgttttttatgggaacagttgcttttattggtgtgcgatcattaaaacgtcaacaagagcaaaaagcacaaagcaaaaaaacacattccattggtgttaattcataactgaattaatacctgcaacctttacaacaaaccttgatcatgccattggcgtgttcaaggttttcttttacccgactgggagcaatttcccattcggggggttgttccctttttttattggagaacaaccatgaaaaaaagaactcaacctgccaaagatttataccaacaaattacagaccaaattctcgaagcattagaacaaggtgtgatgccatggcaaaaaccttgggatagtggatggccacaaatggctattccatgcaacggtgaaagtggtcgtcaatactccgggatcaacgtacttctgctttggatgagcgctattagaaaaaactttactcaacgcaagtgggtaacttttcaaggagcaaatcatctaggtggccaagtccgaacaggtgagaaaagtacagttattattttctataaacaaaatatgtttgaagaaaaagacgatagcggaaacattgtacttgatgaaaacggtgatccgaaaatgaagtcatctgtatttattcgtggtcatcacgtgtttaatattgaacagtgtgaaggcttagaaaaatactatgaagaatatcctgaaccagaaaaatcttctgaaatgcaagctcgtccggatttagatgtattacccaataaaatgggtatgcagctgtataacaaagcacaagatcgtgcttgttatatgccgagaaaagattgcattgtgatgccggatttcaaaaaattcaatacagctgatgactactatgcaactctactgcatgaatgcggtcacgccaccgggcataaagaccggttaaatcgtgacggtgtagctaaatttgataaatttggttctgaacaatatgcatttgaagaattaatagctgaactcacaagcgcctttacctgtgcgcacgtgaatgtttgcaataatatttcacaaaatgcagcgtatattgaacattggattaacgcattaaaagccgataaaaaagctattttccgagcatcttctcaagcacgtgaagcaacacaattcttgttaaatgctctcgaattaacatcgaatgaagaagcaaaattagcggcttagcctctattaaaccattctaacgttttttgttagagctctcataaaccaccctttggggagtaatcctcaaaggggattgctcccgttattttaggagtaatctatggatttcgagaaaaaatttaccgcactttttaaatcgatagcaccacaatatcgacgctcagaagtgttttacgactttattacaatctttgccctggaattctatctcattatatatggtgcacaagcagatgaatcgttgagacaacgttatcagacagctggcgagcattataatgaagatgaaaaacaagctctcagtcgccttttcaacattattgttgaggctttggagcataaaacctatgatttcctaggatcagtgttcatgtcgttggatttaggtgatcaatataaagctcaatatttcacacctagtcacattgcacacttaatggcagccgtaactctatcagattgtcatagtttaattaaaaaacgtggctttttgacattgcaagagccaacttgtgggtcaggcgtaatgattattgaggcttataattatttgcgtgaagaggactttaaccctcagcaacaaatgtgggctcaagcaagagatttggattttactgcagcattaatgtgttatatacaaatgacactcttgcatataccgggagaagtcattattggtaacacccttaaagatgaggtgaattaccatttatacacacctgctcacataatgggaaattggaacaaaaaattggagagtgcagattcctatactgaagcagaatatcaagttattgaacctgaaccagtagaagaacccccgcttgacattgattgggaaaatgagccaatgttttactaacataaacacccttatctaaacagataagggtgtttacatatttaacaatgtacgcattggcgtaaataaggagattttaaacatttacacaaaactgacaaaatagtgcttgcaaatgaactgtatattatataatatacaatcatagccaagagataaggctataccctcaaaaactttaaccagaccccaccaatcggcaggggcagaaaaaggaaacaaattatgtactatgtaacaaacgatcttgcgattgacaaaaatacttatactagacttgatttaggcgatgatgacgtgattttatgcgcaggcagacaagctgatgatgcagatacaatcattatattttttgagacaaacgcagaccctatttatatcggttgggctagtgtggacaccggtgatgtagagattacttatgatgattgggataattactttgccggtatcagacaagatgatgttattgacgagattaatatcctattagatggcattaaaatttatgacaatatgacaggccattttccgatttacgcgaatgatcacaacaacgttgtcggtgagcataaagtttactttaaaactgatgaggcatatcctgatccaagcattgataatgcaaatagagaggatggatatgtaacttataaggcgggcgctattactgaaatgggtcgtaaatgttatgtttattgggattttgttgcgtatgatgatgacggaaacgagattgattctgattattttgattatcagaacactgattgcattatcaaatattattaacaacaagccacgtaagtggctttaattagagcttttaaaatggcaaaaacagcagtacacctatcaaaaaccgcattgcaatatgtgacagaccgtacaccacagggtgaacaaaaaggattgtcggctcatattaataatgcatttgagcagttagcacatttgacgcgcgcagaaaagccggaactatcaaaatcggagtgggttgagttatacaatgtctatgcgggcagtgatttaactcgacttgtaatgccgtttgatttggcagatgacttacgcacacactacggcactttaccgcaagatttgaccgcactttacaacaaattagcggggatgacacaggcgcaacaatttgctgtgcttgatgccgtccgagtgtattgggcgagcggcgaagatgggaattaaaaacaagccgataacaagaccatgcccgcagtgcggcagaaattatcaatatcggcgggcaagtgggcgtacttttgagctttgcgaatattgtcgcaatcttgattgtgtagtttgtggtaaaaaagtaccgccggaacgtgggcggaaaaatacttgctgtgcggagtgcgaaaaattgaagatacacaatatccaaaatgcgcactacgccaaacggatagcggaagaccctgagttaaataaacgcaaccacgccaaagcccgcgaaaaccgaaaagcagacccggaacgaatgcacgaacatttggaagcacaaagggaaaggcattatagacgtgtgcaagatccgaattatctagccactcggaaagtttatcaggctcaacgatggcaggataaaaaagatgagatactggctcaacggcgcgaattttgggatagtttaagcgatgttgagaaagcggagcgacttgagcgcaatcaagcaatacaacgtaaacataaagccaaaaaacgtgaccagttgaaattagatccgcaaaagtgggcggaatatcaagagtatcaacgcacaaagcggcgcgaacatagacagagaaaggcgcttaatgaattaatggtcggcacaaaggagttattaaatgttaccaacaaagacaaatagttttgatattgtcgccgttaaaagcatgacaatccaagatttaaaggcggaattagccaaaacactaagcattacggcggaatatctcatgtatattgcggcaatatggcgggagttagagtcgcgtggagaggacttgagcgagttacgccatggcgtgatgacttatatcccgttaatcgcaacaaatcaacttgacgcgcggcttgttgtcaattatgccgggcaaaaaacgctgttatccagcatggcaaaattaccattaagagagcaacaaaaactggccgaaaaaggcactttggatgttgttattttgggtgacgataatcaacagctaattaaagaagttaaaatatccgacctcacagcagcccaagtttatcaaaccatcggtgatggcaaaataaaaacaccagaacagcagtatcaaatcctgttagtccgcaataaagtgcggtcaaaatcaaagccgaaaaagacttaccgactaacgcaaaatttaaaaatagatggtaaaaatttagtgattgccggaaaacatgcggtatccattgagattttgaaaaaatatttagaggataacaatgagctatagcaagttaagcaacaccaggaaaaagactatcagtgttaatgctaataaatacactaaggataactatagacagatacttttacgcctaaagccagatgtagcagatatgtttgattcaatctgtgaaaaggaaaaattatcaagggcggaaatgctaaaaaaacttctagaaacttattcaatataacaaaacaaacaaaaatggcagagttgagccctgccatttttgtttataattctcagaaatacttagctgtttttttctactcttcagacattaaattttccctattataaataccttttagtctcgccaccgttgatttagataaatcatatcgtttcattactgttgaaatagaatcaccagctttaaaatccgcataaatctttttacgtattttatctgtcactttaggtgggcggccgcctaatgcatttttatgacctgaagcaagttttgttcgcttcccttcctgagtacgctcgacaataaaacttctttccaattcagcaaaaatacctaacaattgaattaaggccatccccataggattgttttgggttcgggtatctattccttgttgtattgcaacaaaaccaatatttttattcttaaatagttcaagtgtattcaaacactgagcaaggctccttcctaggcggtcaagcttagttactgcaacaacatcaccctctcggacataatccagtagttcatccaattgtgctttatttttctcagctttaccggaatgcttccctgaaaaaattttcttacagccgtattcttttaatacttgaatctgttcacttagatcctgctgttgagttgatactcgagcaaatcctattaatgccatcttatctcttaaaattatttaaaaatgttattaaatgactgttggttatttcttttagctaaatttataccagcttttaaaccctctctaaatggagtgcttccaagcggcgtcaatggttgaataggtgctaaaggtagcaatgcggatgctcccataatcattctataaccttcttcaaagcctttttgataatcatagtccataattaactcctttattaaaaattcaaaacattaaatttatatcctaaatatgcaaaaattatcgctagcaatataaattccactaaaaaatactttgcgataccgatcttctttgtaagaaaacaaacagcagagataacagcggtcattcccatataaatacttaaaagttcaactatttcagctccattaaattcaagctgtttaagtaaaattgcaggagcaagaaaaaaagcaaataaccccagcataagcatgttggcagacacaaaaaccttgaaagaaacacttttaaactgcatttttactcctttgttcaaaattcaaagttttcttaatttatcttttaaatcatctagattcattctattagggttcttttcggtatctagtaaatagagtccaaaaccgcaccataagattaaaaacgttattacataaaacatttgtatcctcacttatcaaaacttaatagttaatctctttaatggctaacactttgtatttcagataaccatattcaatatgcggtaaatgatgaatcatacataaatcacctattttttgttgagaaataggaattaaagcccctttccatacatctgtttgatatggttcggctgctatcactataccttgttcatccgttcttaactttgtgaaatcctgtcctttgtcctcaagttcaatttcatagcctttcataaatactcctttgttcaaaattcaacacttagaaaaatcagattctttttgttcccatttttcccatagagtgaaaacgacccctatttttcttgatcgatttacaacctgccccaacgattttgttagagtgtaatcatcagatatgtaatctgtacctattactgttacctctttaaaaggtaaatcaatacctttttccaatttcatttcacataaataaatgattagctttaatttatctatgtttgctaatcgaatttcattgtctgctagacaataatttaggcgaactgtgattttttccattttttgctccttgtatgtgcaaaacttaagatttatcaattttgcttttaagctcaataatcttcttttctaaaagataaactctaatccacaaagaaattatgcaaagccacaatgccactaaactgaatatttctaccatcgtttttctcctttgttcaaaactttatactttttagactatttgttaatcctagtctaaaaactcatactttacccgttttcagactatctaaaaacatctatcaaagtttttagacagaatactcgctcaaaataaaaatacagcaataaattgatttagaatcagagataaattcttctaccaaaaaatagtaattctcttagaatctccaaaaaactactaaaacagagccatgttaaatgtctttttaaaattactaccattctttttaataagcttaatggttgaagcaaatatcagagaaccgcacatcgggggaatctgtcatgtagaagccgaatatttttaccctggagtgtgggaaaaatatggagaaagtgaattaatctgtaactattggaaatttctaggagacgaagatcggcaagtattagagtcgcaactatcaggtgatgagtcagatggtgaatatggtgattacgatagcttaaatgaaatggatagtgaataaggagaaagcgctataatgcctttgataatcatggttagggctgaaaatttcgactgatttctacttttcttaatctaaaatgacaaagaccaccgaaatggtggtctttgtcactaaatatataggatgggaaaattaagacattaagacattaagacaaatgcttaatctgtgcaacctatcagcgtggttaatagtatgatagaatcataccgttgtcaatagtcaatcaacatctaaaccatgaatttaagtattactaattttatcacatctttttctagagagcggatttctgtttatcaaaactacattcattcttctgaacctaatctatctcctgctgatattagcttgaaatcactaaaattatatttgtggaatattcagatttcatcagcactttttgaagtaataaacttatatgaagttacgttaagaaacaaaatctttgctgtagtgaatagtgaatttagcgattcaattaatgattactacttcaagaagcgcttaagctccttctttagagataagttgaatgaattgggagcttcaactatcagtgcaccaatgatcgtatctagattaaacttcgctttttggaccgaagtattgaataaacatttctattattctggtagtgtaggtaagtctgggcatccactataccctcgcttatataatttcaatagttccttgttttcaataaataggaagctaactagagaagattataacaagctaacccaaaaactaatcaaaattaatgatgaggtgaatgaattaagaaatagaatttgtcatcacgagcctattttcaagtctaaactaagagctatttatataaagatgctatttgttctcagatgtttggatacgaatgtctataaattggcaaaagaaattgaacgcgtaaataaattactaaaaaaatttgaagatgagataaatccctaaaaggaaaaagcaaatatgctactctagataaaattgatggctaataactaataagtagaaagaacaatggggagtaaagctccccattgttctttctagccgctgcctagaaattctctacttactcattataagccggccgagtagcactctgaggatccctactatatttaacgaccgaggggatatttacccagtcaaaaacatatactaaaaaacgtattaattaacatgaattatcagtaagatagtataacatttccgctctaattgtgtggtgtgagggactatcttctctgggtattgtccttcttttggaaaacattgtcaaacttatgtatcaataatcggtcttctccccacctaacatccagttaactcccttcattaatgcagattattcattgagtacttttatcaattattatgtccttgatgaaccacccaaaaagctaaaaggttaaaggaatctctaacgggattaagggtcaaaggtaacctttcctaatggaaaggtcttacctaaaaaggccaaaaggcttttttttcaaaaggctaaaaatggcatcaatatcattgattaaacattattaacggaattctaaaacgaataagattaagataaaattttacaacttgaaagataacgtttatgtgaataaacgtaaattatgaatgattatagaaattagtaaggtgatggaaaataaggagaactaatggttataagtacaggattaaaatgtgagttatgcggacatcgctacagaataagggttggagttgggtttgattcttatcagaaacactattttgattgttctaattgcaatattaatatagtctttgctataaggactaagcctccaagagctgatgtagaagccgtagaaaattgctctcttttttcgggagagcctaatattgaactcgaagtcttaaattttcacccaaattgtgcatttaataaacatgatttacataatcctttttgttttcctacattaatttcggggcctctaataattccacatatgaggtatataccaggtagaatgcaaagttttgataatcaatttgatataccaaatgcaccacacaaatggtctttgattaaaggaatgataactaatatccaagataacaaaaaagcttcaaattttgttttgcaatacactaaacatagaaacaaggatatgaacccatcatcatctaattttatgcgcgataaagaaattatagtttataaatcaggtagtgtttatagtgaatttcatatcattcatgaattttttgattcccttttttaccctatgttagaaaacattgtagaaccgataattaatacgattaaaaatattcctgaaagcaagctttctagttttattaggtattggcagagtgagttaaaacaagaaaatcaatatcgctatttaaatacattctctgaatattttcgccatagagatcacttcggtcaaatagtaatgtattctagaatcggacataatgttgatgatttaatagtgtcatctaatgggtttgagcagataaagctatattatggagatgcctatgaagcgctaacttcaaatatgactattattgcttgtttgaataatatcatggacggtagagagtttgatgaatttaagtcaatgaagctatcaaaatacctagaaataaataaagcaaataaatcaaatccatttaaattaactcctatattttcggtctttgcagaaaatgatattgaatcttctattcgaaatggttctcatcatgcgtcaatatggcgtgatggtgaaaaaataatgtataaaagtggagggactggagctgaacattgcattccatacactcgatatctggattattgtaacaggttgaccattaaattagccgctttatttataatagaatgctaccttagtgaatacgttaatgattcaaaaagttttgtagtaaattaagaataagtaagagtatcaatctatccatgcttggtagctactctttctagcgatattaagcttgtattaatatttattcttgaatcaaagtcatttatttattgagattaactcataaatcggtagcattttgcaaaaatttatgggttatttttttatgttttcatcaattttttatcgattaaaagggaaaaaacaagattcctttactattccagttctagattcccataaccattcaatgtcaaagattgatagtgagggatggataactccgttctctgcgtcagaattactcaattctgaattacgccaaaaatacttaaatttactttggcaacaagtatcaatgacgcaagatatgtttaatgagctctataaaaaacctatcgagcgctacgctgaaatggttcaattactacctgcctcagaatcacatcatcactcacatttaggtggtatgcttgatcatggcctagaagttctttcatttgcagctaaattacgacaaagttatgtattgccacaaaatgctgctccggaagaacaatctaagcaacgtgatgcttggactgctgctgttatttatgctgcattggttcatgacattggtaaagttattgttgatatagatatacaattaaaagatggttctcgttggtttccttggttaggagtgccaactcaaccttataaattcaaatatattaaagggcgagattatgatcttcacccggttatgggtagttttcttgcaaactatttaattcctaaagaagcatttgcatggttagcagaatacccggaagctttttcagctttaatgtatgccatggctgatcataaagataaagctggtttattatctgaaatagtacaaaaagcagaccaaaacagtgtaactcttgcactaggtggagacgtatcaaaactgactcagaaacctataacatcatttgcaaaacagctagtcatggctttacgtcatttactgcaacataaatttaaaattaatacacctaaaggcccatctgatggttggcttacagaggatgcgctatggttaatgagcaaacccactgcagaccaaattcgagcttatttattggagcaagggatatcagctccagcagacaatcctaaattatttagtgaaatgcaatcgctggggattattgaaagtacaaatgatggtacagcaatttggcattgtcgaattaaagctgattcaggctggtgcccacctaaagcattttctttactcagaattaaaccggaagtagcttgggaaaatcttaatgacagacctggtatatttttaggtcgagtcgatattgaaaatgaagaacaattaaattcaggtgaagatactaaagaagaaaattcagtgattatggaatctgaaatgccacttcctgcaataacaggtacactgaataaaccggatttatctgaaaatacatcctctcaaaacactcaaatcaatacccaaaactcagaaaccgagacggatatgactgatttggtaatgaatttattttcacctgtagaagaatctcaagactctactgataaaaaaccatctcaagaaagtgaaataaataaaatcgcctctaccccatctatagcaacggatgatgatacaaaggaaactgaggctgtctcaggagagatttttgttgaatggctaaaatctggaattatcgggaataccctaactattaataattcaaatgctaaattacatatagtcaaaggcaaacttttccttgtaacacctggaatctttcagctatttttcaatagtaagggcattactaactttactaaaaaagatatcgaaaatttgcaatatagtttccaagaccttaaattacacaagaaataccgtcaatcaaacaatgatagtattaatttttggcgctgtaaggttattggcccaagaagaacctctcaattgattgggtatttgattgataaaaccgactattttttcggtaatagaattccaattgataatttgcatttatcacttattgaggaaaatgaaagtgaatagaaccacatttgatatgttacttagtaattttttttataccgtcatttacgtatagatactattaaaagctatgaaaaagcaattagacaattacagaaaaattgtagtattcaatatcctgatgaaatatcagactcattaatactccaatggagaaagagagttgttggacaatctatcattgaagtgacttggaacagctatattcgtcagctaaagactattttcaaatttggaattgaaaaacaactcctcccatttacaaagaaccctttcgatggtttgttcattagagaaggaaagaagaaaaggaaagtatatacttcttcagatttaaaaaaacttagctttggaattactgaatcaaagcatcttccttctattcttcgcccattatggtttactaaaactataattatgactttccgctatacggcaattcgacgctctcagttaaataaattaagaattaaagatgtagatttgctaaatcaagttattcatattccatctgagataaataaaaatcacgagtatcatatacttcctatatcaactacactttatccttatctaaagaaattattaactgaactaagtaaattgaatcagcctgtagaatctcaactatttaacattaatttattttcaaatgcagttaaacgaaagggagagaaaatgaccaatgaccaggtgagctatatcttcaaagttatttcaaaatatacaggaattattagctccccacacagatttaggcatacagcagcaacaaatctaatgaaaaaacctgaaaacctatatatagccaaacaattactaggacataaagatgtcaaagttacattgagttatattgaagataatattgattcaataagagaatatacagaattactttagataggtatgcaaggagcatctaagggtgttccttgcaaaataaatttaaaccgctcattctcagcttattcatccttataaaaatatttttaaaattaatacattcaggctttacaaactagtatttttgtgtaagatctaacctatccacagagcgttagtgggtagatcatggtgtattggctaggtacacggaattggtctaaacaaatagttttcaaacttaaatgatgtacacaagggatttaaaatccctcgcctttcgaggcgtgccagttcaagtctggcttcgggcaccatttaaaataccaatccaaagattttaaaatttactttaaaatcatctaattgggtcgttagctcagtcggtagagcagcggacttttaatccgttggtcgaaggttcgaatccttcacgacccaccacttaaaaataaagtaatcaccgaaaaggtatttttttattgcctaaatttaatactactttttcaaatcactgtcttattgataaatagctattctttctattaatgtaaaattaattagttaatatatccttatttttttatctctataccctattttctaaaaataaaatagcacctgaaaatcagatgctatccaaaacacaataaaaatttaccgcactttatgacttcaataagtaagcccgtagttgtgcaaaatcattatccatttcatctgaaagcaatggtagctgattatgtttatccagtgtttcaggtaatggaagctgaataccaagaatacgttctacggattctttaaatttcgcaggatgcgccgtacacaagaagattcctgtttcactcgctttaagttgctctttcaacacctgataagctatcgcaccgtgaggttcacataaataacctttcgactgcatcgcttttaaggtatcttctgtttcgctatcacttagcatccccgaacctaaatcagttaaatcccaaccatttcgtttaaacaattcttccactctcggccaattgtttgggcgacttacatccattgcattagaaagggttgcaactgtcgttttaggatcccaattacccgatttcaaataacgtggcacagtatcatttgcgtttgttgaggcgacaaagcgttttatcggcaagcctaaggtttttgcaattaatcccgccgttaagttaccaaaattaccacttggcacagaaaccacgacattatcacgtttttcttttggcaattgtgcgacagcctcaaagtaataacaaacttgagctaataaacggctgatattaatagaatttgcagagttcagcccgatagcttggcgcaattcaacatcatcaaaggcttgcttaaccaaagcctgacacgcatcgaaatcagcgttaatcgcaacagtacgaatattcccacctaaagtacagaatagcttttcttgtaatgggctaattttgccttttggataaaggataactacattaatattttctaatccataaaacgcatgtgctacagcggctccagtatcgcctgaggttgccgttaaaatagtaattttgccatcgccacgtaccgcagcaagtgcctgtgccataaaacgcccaccaaaatctttaaatgctagcgttggaccgtgaaataattcaagtgcataaatattatcttccactttttctaacggtgcagtgaaagtaaacgcattttttaccattgcatctaacgttgcttgtggtaactcgccatcaattaatgcacctagaattttttgactacgctcaacaagaggcaattcaagtaattcattaatgttattaagtttaggaataacttctggaaagaatagaccttgatcccacccaagaccttgacgaacagcctgagaaaaagtgacttgttcttctgggtgtttgatattgtataaattcatatttaatccgtttttaatctgatttcatctatttaaattaacttatttaatttctcttgtgccttcgttatcaactttacatacatgcacaaaaccttcattattttgtaaataatggctttctaaataacttgaaagtttaattgcagtttgtaaatcaggggcaatagagaaaatagttggccctgagcctgaaatacctgtggcaagtgcgcctaagtctcgagtagcttgttttacttcagcaaaattaggtaacagagattcacgataaggctcggcaatgacatctttcatcataatcgcggcaagattttcctgatgggtatggcaagcatgcacaaagccacctaaatgacgaccatgggcaatcacgttttgtcgagtatagcttttcggtaaaattgcacgagcttcagcagtagaaacttcaatccctggataggctaacacccaataccaattatcaaaaaatggcaatttttgacaaatattgccgagcgattgcaccataaattgcacaccgccaagatagcaaggtgcgacgttatcataatggattgaaccagaaatacgaccttccaattctcccatcatttcaagcaattccattttcgaaaaaggttcattatgaaactgatttaatgccactaatgcagcaacaatagaacaagcactagagcctaaaccagagccaataggcatatttttttcgagcgttaaacgtaaaggtttaacatttgctccgcgtaattttaattgctcgctaaatagcacataagcttggtaaacaatatttttttgtggttctttcggtaatttacgaacaaaatagcccgcactttctaactcaaaaccacttgaaatagattctatttgaaccacatcgcctaacaaagaaccatcaataggagagatcgcagcacctaaagtatcgaaacctacgctaatattcgcgctagatgcaggagcgtaaattcttaacattggaaatccttattaatgttgtaatgttcttaaaatatctgcaaagatacctgccgcagtaactgcattacctgcgccataaccacgtaataaaagtggaatcggttgataataacgagtataaaatgccaaggcattttcaccatctttcactttataaagtggattattcagatctaccgcaacgatggatactttgcattttccttcactaatttttccaacataacgcaatactttgccttctgctttagctgtggcaacgcgagttttaaactccttgtcaagctgtggcaacattgccataaactcatctgcagattttccttcagagaagcctttcggcaatacaccttcaacttcaacatctgaaagttcaagttcaattcccgcttcacgagcaagaattaataatttgcgcgctacatcttgtccagaaagatcatctcgaggatctggctcagtaaagcctttttcacgcgcaagtgcggttacttctgaaagagaaagtccttcttccaacttaccaaaaataaaggaaagcgagccagataaaatcccttcaaaatattcaagctcatcacctgctgcaagtaagttttggagattttcaataactggcaagcccgcacctacattggtttcatataaaaatttatgctggcttgcttgggcattttggcgtaactcattgtaataaactaattctcgtgtattcgcttttttgtttggcgtaaccacatggaaaccttcttttaacgcacgagcataaagccctgctacagattcggctgaagtacaatctacaaatactggattcaccacatgatgtaatttaatgaaagaaagcaatacatcaaaatctgatggctgagtcgcattttctaaatcgtttttccaatcctctaaatttaatccattttcatcaagcaacatacggttggaattcgcaatagcacaaactcgaatttcaacattcttctttgctagatactccttttgacgctttacctgctctattaattctccgcctactccaccaacgcccactaaaaacatatccacgacttttttattattgaaaagcgcctgatgggtagccttcaccgcttcaatggctttattttgcggcacaaccgcagaaattgaacgttcgctagatccttgtgcaatcgccacaatgctaatgtttgcctgcgctaatgccgagaagaaacgagcagcaatgcctttcgcttgcttcattccatcgcccacaacagaaataatggataaatctttaatcacttcaattgattctaattgatgttcatttaattcattagcaaactccgtttctagtacggttttcgctacttctgcagatttcacaggcacacagaaactaatactatattcagacgaagactgagtaattaaaataactgaaatgcctgcgcctgacatggctgaaaatacgcgagatgccatgcctaccataccttgcataccggggcctgacacattaaacatcgccaaattgtctaagttagtgatacctttaacttgcaaactttctgatttcacattgccatcaataatcgaacctggcgcagaaggatttcctgtatttttaatgacacaaggaatattttgtggcaacaatggcccaatcgtacgaggatgaatcactttcgcaccgaaataagagagttccatcgcttcacgataagaaagcgttggtaataaacgtgcatcaggcactaaacgcggatcgcaagtataaacgccgtccacatcggtccaaatttcgcatacacttgcgcctaaacaagcggctaaacaggcggcagaatagtctgagccattacgaccgagcaataccaactcgcctttttcattacccgcagtaaaacctgccatcagcaccactttatcttttgcgatatttgctgcatcaacacgttttgttgattcttcaatttcaacagaagattcaagataaccgccttttgccaataattgtttgacaggatccacaatatgtacgctatagccacgcgcttcaaaccaagctttcatcattgcaatagaaagtttttccccacggcaatcaatggtcgctttaactgcatcttctacttttcctgcctgacgaatttcttctaataatcctttgatttgagcaaattcagcatcaataagtgccttggtgccatttaagtcgaattgattattttcggcatgtaagccattgatgatgttatagaaaatttcgattgcttcgttgaaatgcgtatcggttgattgatttaatgcagctttttcagaaagggcgacgagatggttggttattttggctggtgcagataaaacacctgcagcctgctcttctaaatgagcttgttcgatcaatttcgccgcttgggaaaaacgttccggatttgcaagcgaagtgccgccaaatttaagtacgcgcataattggttctcctagatattgtgtttttaaatttataaaaaaacccgctattcagttgaatcgcgggttttctgtatcttgtttttgctgcactaacccgcgccattaatcataataatggtcatcataatggcggtaatcgtgctaatgattacggataaagtgcggttatttttcattgtgttttatcttgaaaaatgaatgcgtaaagaaataccgaaatttcccgagcttgtcaaacagaaagtgacaaatttttcagaaattttcttagtcaataaatttcgtgtaaactaaccgcacttttttataaaggaaaacctatgaatatccagcataatctcaacctaattcagcaaaaaattgaaacggcttgtaaagaagaaaatcgcaatcaaaataccgtaaaattacttgccgtatctaagaccaaacctatttccgagattctttcagcttatcaagcgggacaaacggcttttggggaaaattacgtgcaagagggggtagaaaagatccaatattttgaatcgcaaggagttaaccttgaatggcattttatcggcccattacaatcgaataaaacccgtctcgttgcagaacattttgattggatgcaaacgcttgatcgagcaaaaattgcagatcgtttaaatgaacaacgaccgaccaacaaggctccattgaatgtattaattcagattaatatcagcgatgaagaaagtaaatcaggtattcaacctgaggaaatgctaacactagcaaaacacatcgaaaatttaccgcacttatgcctacgtggcttaatggcaatacccgcaccaaccgataaaatcgctgaacaagaagccgtgttcagaaaaatgtcagacctatttgaacaactgaaacaagccttacccaatcaacaaattgatacactttctatgggaatgacggatgatatgccgagcgcaataaaatgcggttctacaatggtacgcattggcactgcgatttttggtgcgagaaattattcaacatcacaaaataaataatcatggaataaggctcgaatttaaaacaagccttatttcttaatgaaatttaaatgccagtactctcgccacattttgagcggtagaaattaaattttgttcgccttgtttgagaatatccgataaatcgccaagttggtgaataatagggaacaccgcatcaataccgtgatcaaacaccacatcataatcttcacgcaaacaccctgcgatggcgatcactggcttattgaactgttttgccgtacgtgccacaccaattggcgttttacccataatactttgtgcatctattcgcccttcacccgtaatcactacatcagcatcttttacatggtcaattaaatgtaaccgctctaacacaatttgtatgcctgctttcagttgtacgcttggtaataatagcaagccaccacccataccaccagcagcacctgcgccagcctgatcacgaatttgtttaccgcaatcgcgttcggcaatttcagcaaaatgcgaaagtgcagcatcaagttgtttcaccatttcaggcgttgcgcctttttgtggtccaaaaatggcagatgcaccacattcaccacagagcggattattcacatcgcacgctacttcaatgtgaacttgttgcaaacgtggatctaattgttgaacgtcaatcttcacaatatttgctagctctgctccaccaaaaccgataggcttatcttgcgaatctaaacattgcatccctagagcttgcaacattcctacaccaccatcgttggttgcgctaccgccaatgccaagaatgaaactctctacgcctaaatctaatgccaatttaatcaactcccctgtgccgtaactggtggtaagcaagggattgcgtttttcaggcggaacaagatgtaaaccagaagctgctgccatttcgataatcgcggtttttccatctcccgataaaccgaagaaacttttcactttgtcacccaaaggcgcggtgacttcacattcaatgagcttgccttgcgtggcatccacaagggattgaactgtaccttcgcccccatctgccattggcaattttacatagtccgcatcggggaatacacgtttgaagcctgtttcaatggcggtagcgacttcaagtgcggtcaaactttctttaaaagaatcaggtgcaatcacaaatttcataacaactcctagaatttaaatacgccaaaaattaaggtagaaacgatggtcatcatcaaaccgaccgcactttcataaggaataagttttaaacgttctttgatatccatattcacactaccgcctgtggcatggaagaaagaaccatgtggcatatgatcaaatacggtcgcccctgcatgaatcattgctgcaccagcaagactgctaactccaagttctaacaaggtactactgaacacattggatgccaccgcagtacctgccgtggtagaagctgtcgctaaagacatcaacacccctgaaattggtgcaagaatgtatgatggcaaacctgaatgttccaaaccttgaatcaatacttcttttaaaccagaattagcaatgatgccagcaagcgcgcctgtaccaagtaacataattgccacgggtgtcattttactcaatccattgatagcataactatttatattgcgaagtttgcccatacaaagcgcaccaatcaaaccacctaacggcaatgcaattaatggatcaactttaatatcaaacaatggacgaagtgccaatagcaaaattgccactaaaggtgcgacaagtgcggtcagaaatgaaggtaaattttgcgtttcaagcacgattacctctttgtcagtcactttagaacctttgttgattaagcgttttgctaagaagtaggtgagaatcaaaccaaatagcgcgggaattataccagccatcatcactgaagtgagtggcaaatgaaaagtatctgctgccgcaatggcatttgggtttggcgacataatattaccagctttaccaccgccaatcatggcgagcaaaattgcagctttcgataaatcgctgcgacgcgataacgctaaagcaattggtgaaacagtaatcactgccacatccacgaacacacccaccgcagttaaaatcatcgtcgctagtgccaaggcgagtaaagctcgagtttcacccaatttattagtaatggtttccgcgatggaatttgctgcacccgattcaatcagcacgcctgccaacacaccagcagctaagatacgcataactgcagtagtaataccctgtgcgccaccgatcattaggctcactgtttgcgataaatccgcaccaccaattaaccctccaaccaaagctcccaccaacataccataagctggtgagacttttttcaaaatgaggaagatagcaacgattaacgccaccaacgcacctattgctgagactgttgtcattttttctctcctataaaaattaaaaccaaggagattatttctgttttataggggaaatgctttattagagcaaacaaaaagtgcggttaaaaatcatcaaactttgtaaagttatacaacctcaatgttctaacaacgttccgagatagagcgttaatttatcatctatcttattgaaaaataaaccagttatttgctctattttgttcaatcgataacgcaaagtattcgggtgaacaaataatttttccgcagtgagataaagatcacaatttgataaaaaatattgttgaagggttttataaagtgtcgcattttcttctgagaaaaggggagaaaggggttttatcaattcgttcccttgccaagaatgggataatccagcaagtaacacaggcaatcgatgctcatcaaacacataaatacccttgcgtggatgatgttttaatccataagaaagcgtgctttgcgcactttgaaaagacaagggaagctgctcaaaaagcggtagatttagacaagcgcctacagcaattttataatcttgttttgaataatctgcaggtaaaagcgttttcatttgagcagaaagtacggtggagttttgccaagtctttaagaccacaacctgatcaagggacaaaattgccacatcctgtgcaaattcagactgttccaaataattgatcagatgctgtaaattatccagggctggattaagtaacttaatcaatacaaccacacgagatttatttaaatcaaaagaaaaaaatttcgcctgctgttccatctttttccaattcaaattgcaatgtaataattgcaaaataaattcttctttgtaacgacgatgccagctttcttgttcgagtaaagcctgttgttccacaataagttctgcggtcattttcactagttcggcatattgtttcacctgagttggctcaccagaaatccccaccactccaatatttttgcctaaataatgaatcggtaaattaatccctggttgcgcttcaaaattccatttttgtgccaacgcttgatcaatctctaccacacgattttcccgcaacgccaacaccgctcctgtgtgccgttgattcaaacgcgttgaatttcccgacgcaatgatcacaccgtcgtgatccattacatttacagagtgatgaatgatcttcattgcacgtttaacaatttttttggcagtgtatttgtcaagttgcatatttgtaataaagaagataaatgaagataaaatattgagaaaaagaaagttagtcaaatattgttttatctgcaagaaaagacgggagactattctcccgcactgcgtttttatcgctataatgttttattctgaacttgaacatatcccataattaatgccaaaatccctagtggaaaaatgagatctattacagaaccatcatttccccaaatcaagaatagctttgatgaaaataagtaaaatcggtaagacaataggaatactcacgacatagcccgtaatggctaatgcccattcttcctttttcttacctagaaatttgataaaactgaacgccattttttcagcaactgggcagattgaagtttcaccatgtaaaggttctcgaataatgctacttacaaaggaagaagtcgctttatttggttttcctggacggatacaaattgtgagcaggcgaacacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaaataaaacgaattttagtatcagattcatcaaaatatgagaaagtggcgacattccatatttgtccactaacaaattttgatcacataatttgcgacaaaaatcttgttgaatctgcacagaatggcattagagaattaaatattaatttaactatcgtataaataaattaatataaatgatctgcaccccaaaactaaacaaataagcttactcattaaggtgcaaatcaaagtgcggttcgtttttatattatttttggctacatacagcaataaaatgtaatttatgttcaggatcattaaaggttttgaacattcttttaaattgctcacgattttccgctttcatcgcattacggatgatttttaacgtaccgaaaattccttcatcataaatcattccttttggagaaagtaatgtcatctcaccagagaaagtatcaacatatctaaagccactttcttggaatatgcctttccatccatctttcgttaatggcgtgacagtcacattaatcgctttgcgcatattttctagaatagtttgatgatcattccccaccagcataacatcgtgagtaagcaataaaccattgggttttaacactcgaaaatattctgcaatggcttttttcttcgcttccacgggtaacattgtgagcatcgcttcattgatgacaatatcaaaactttcatcctcgaaaggcaacttcatcgcattcgcacgctgtacatgaattttttcttgcaagccatttgcttcaatatttgcttgtgcttttgctaacgcattttcatctaaatcaacaccttcaatatgacaaccaaattgtttcgccaatccaattgcagtcgtccccatattacaggcaacctctaacacttttttatcttggctaaaatcgccattagcaattaaccaatctgtcgcttttttaccgcctggacgcaaacgcgttttacccaaacgtgcaagaaaattatgccctacttcatcttttgccatttttatctcctagtaattaacttggtttttatattatagataaaaatgataactattaaaatgatagattaaataaattaaggcggaataattgttccgcctttttctcttatttcttcaatgcttttttcaattcaatttattcctttgaagataacaaaacttacataccgaaacgctttactcaatatgtaaaaacattggtagaaggcgcaaatcagtatattggtgctggaaatatgtataacggcgacgtagaagatttgaataaaccgcatctttatatgatgtctcaaatggaaaaaccgacaactaaagctgagttgaaatcagcattacaaggctatttaattcaaaatgaatatcaagatatgaataacaatgataaattgattgatgaaacttatgattgcactgagttgtttaatgcactttgtgatgtattaacaagattaggctatatccagcctgtaaacctataatctatgtatggttcgtttaatgtaccgttttgtttttcatctaaatatcaatttaaattgagaactatttgcatttaaataaaattaggcatagaatagccacaattcaggctgaactgaataatttgcactcaacataaggagcttttcaatgcaatttaaacatttcaaacttgctacccttgcggcagcacttgctttttctgctaatagttttgctgatattaccgtttataatggtcagcacaaagaagccgctacggctgtggcaaaagcctttgaacaggaaacaggcattaaagttacgctaaatagcgggaaaagtgagcaacttgcaggtcaattaaaagaagaaggcgataaaacaccagccgatgttttctatactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgcgtagtggtttacgatcacactaaattatctgaaaaagatatggaaaaatcagtgcttgattatgcaacaccaaaatggaaaggcaaaatcggttatgtatcaacttctggcgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcttctaaaaatcaagctgaagcacaaaaatttgttgatttcttagcgagtaaaaaaggtcaagaggcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataatccaaatattgcgtgcgtgtatttgaaaaaattcacgcacgcgtttacaattctctaacaaaattaaccgcttgcgtgcgtgaactgaaaggttcacattcctaaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaataaaatgataaataatccgttattaaccgttaaaaatctcaataaattttttaatgaacaacaagttctgcacgatatttcattcagcttacaacgcggagaaatcctctttttacttggtgcttcaggctgtggcaaaactacattattacgtgccattgcaggatttgaacaccccaatactggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacgccacgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggaaaaattacctccattcaaattgaaattaatggctacgcaatatggattgagaacgttatttctcccgatttatctattggcgataatttgcctgtttatttacatagaaaagggcttttttacgcttaacaataaagccttatcttcacgataaggcttatttttaaacaatatattcggaaaaaatttgttcaagatgtgatattaaacagtctgcgcctaaaatattttcccctttccacgcctgttgcaaaatctctggagaaaattgctggcttgccaattcagctaacggcaaataactgatatgccaaggctcccgccccactttcttattggactgcatattcataaaaggcaaagcaaaatcaaagtgcggtaaattttcggcaagaaattcactcaattcaaagaagtagccgcctttttcatattcccaaggctccagttgtaaagattgcccttgtggcaaaagatcaggatcaaaaatatccacttccgttccccaatgatgacggctcgcccccggcaatgcagaccaacgtaaaatcgcctgacatttttgccagtcatctaattggttcaaatctaatgcctttcctgcatcatcgtgtacttttcgctcgcccttaaatttactgttccaaataagtttttggcgttcaaaatcacgaaaactgctcgcaggctgtaaattaaagccattttttgccgcactttgttgcaaagcttgaaatgcttgcatagcttgtgtttgcaaaaaatgatttgatgaatgagttgtgggtaaattgactaaatgctcacgagactttcctgtaagcatttctagggttaatttcattttagctatccaataaattcactaacattttgtgataaatttcaccgcacttgccaagatcttctatactgacacattcattgactttatgaatggttgaatttaacggaccaaattccactacttctgcgcccatcaatgcaataaaacgaccgtctgacgtgccaccacctgtttcagcctttggcgttatgcctatggtttcctcaatagcggaggttatcgaatctaataatttacctggttttgttaaaaagggtttgcctgataaattccattcaatacgatatttcaaattgtgtttttctagcatttcagcgactttttgcttaatgatttcatccgtgacttctgtgcaataacgcaaattaaactgaatatataattcagcaggaattacattattacttcccgtacccgcgtgaatgttagcaatttgtaggcttgttggcgggaaaaattcattgcctttatcccattggtaagtcgttaattcttgcaagaatggggctgctttatggattgggttttcagctaaatgcggataggctacgtgtccttgaatacctttaatatagagatttcctgtaattgagccgcggcgaccatttttgacaacatcgcctaagtttttagcactcgatggctctccaaccatacaataagtaattttttcatcacgcgccattaacgtctcaaccacgcgtatagttccatcttttgcggcagcctcttcatcagaggtaatcaataatgcaatggtgcctttatgattaggatttgcttttacgtattcttctgccgccacaatcattgctgcaagggagcctttcatatccgccgcaccacgcccataaagcatgccatcaataatctccgcagaaaacggcggagacgaccattgattttcatcgccagtaggcacaacatccgtatgacctgcaaaagcaataactggctcgctcgttccgtgttttgcccacaaattcaacgtgtcattaaaaggcatccattcaatttgaaaacctagcttttctaaacgttcggcaataatttgctgacagccttcgtcattcgggctaatagacgggcgacgaattaaatcttgtgccaacgaaaccactttttctctcataaaaactcctaagaaaataaccgcactttaagcaaaaacagcctgatattccttttcattaaagccaattaatgccttttcatcttgtaaaataattgggcgtttaattaaagttggattctcagccaacacggaaagtgcggtggttttatcaagggaatttttaacttgctcatccaaattacgccaagttgtactgcgtttattcactaacacatcccagccaaattgagtttccgcttgggttaaaaaattcaaatctaacccatcaacacggtagtcgtgaagtttgtgttcgatattgtgatccgccagccatttcaacgctttcttcactgtatcgcaatttttaatgccgtaaactgtaatcatatttcacctaaaaaagaaaaatcctcaatctaatcagactgaggattttaacccttatactacttcatctcaaatgaattaacctaacaacttattgatacgtttaataaacgcagctggattttccaaagatccgcgctctgctaacatagcttgttcaagcaacagttccacccaatcagcaaattcagtttcatctgcaatatcagccacttttttcactaaatagtgttctggattcagttcaaatgtgtattttacttctggtacaggttgccctgcggctgcaaacaatttcgccatttgggtcgtcatttgatcgttatccgtagaaaccaccgctggtgtatccgttaaattgtgagttaaacgcaccgttttcacacgttcgccaagcaagtttttcacacgctcaataaaactaccaaaggctttatcttgttgtttttgtgtttcagattctttatccgctaaatcgcctaaatccaaatctgctttcgtgatactttgtaattgtttaccgtcaaattcagttaaatagcttaacatccattcatcaatacgatcggaaagtaataaaacctcaatgccttttttattgaataattccaagtgtgggctatttttcgctgcaacataactatccgctgtaatgtaatagatagctttttgcccctctttcatacgcaagatgtaatcttctaaagagacagtttgctcactaccatcattatgtgtcgaagcaaaacgcaataactttgcgatagtttctttgttagcaaaatcttctgcagggccttcttttaagactaaaccaaactctttccagaatttaagatatttttctgcatcatcttttgctaatttttctagcatttgtaatgaacgcttagttaatgctttgcgtagtgcagccgtaattttgttatcctgtaaaatttcacgagatacatttaatggcaagtcattactatcgattaaaccacgcataaaacgtagataattcggcataaattgctcagcatcatccataataaatacacgttgaacataaagttttaagccgtgtttatgttcgcgattaaataaatcccaaggtgctttagctggtacataaagcaaactagtatatgcttgatttccttccactttgttatgcgcccaagtcacaggatcaacaaaatcatggcttaagtgtttgtaaaacgctttgtattcctcatcggaaacatcatttttagaacgcgtccaaagggcatcagatttattgattttttcccatttttcgccgcactctttgccctcatcatcgtattctttcgtcagcatttccactggcaagccaatatggtcagaatatttaccaataatttcacgcaaacgccattcatttaaaaattctttttcatcttcacgtaaatgtaaaatcacatctgtaccacgagattttttctcaatatccgccacagaatattcgccttcgcccgcagattcccaaagcacagctttatccgcctcttcgccagccgctctagtttttacagtcactttatctgccacaataaaagcagaataaaaacccacaccaaactgcccaataagctggctattttttgcttgatcttggccaagtgcggttaaaaattcttttgttcctgattttgcaatcgtccccaaatgatcgatgacttgctcacgagtcataccaatgccgttatcgctaattgtgatagtgcctttatccgcatcaaagctaacacgcacacgcaagtcgccatcgccttcatataaagcagggttggaaagtgctttaaagcgtaatttatctgccgcatcagaagcattagaaatcaattcacgtaagaaaatttctttgttagagtacaaagaatgaatcattaattggagtagttgtttgacttcagattggaagccgcgagtttcttgattttgtgacataattttttccttcataaagataaaaattgaacgtcacagatataagaataaaaagaaagatttcaagggaaatttaagaggaaaagtgcggtaaaaaacacaaggaatttaaaccgcactttaaataaaaaatttcttatttccccttgatcgctataaatttatatatataatgaattctgttttagatactagatagtaatttaatagtaatgaaacttggctagtgcattcccccactcctttcgcactagccatttttttgggaattttgtaccatatcccgactttttccaatcaacgatccattatgaataatctcgaacttgaacaactcattaatcaaaaactttcttctgataaaatcaatgactatgcacccaacggcttacaagtcgaaggtaaaacagaaatcaaaaaaatcattactggcgtaacggcgagtcaggctttaattgattacgcaatcagccaaaatgctgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgacattgaaaatttacaaccattagaaaaaggcactgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgcactggtggcggacaaggttatattgatcttgctgcagaacaaggctgcgacgcatttattacaggggaagtgtcagaacaaacaatccattctgcccgtgagcaaggattgcatttcttctctgcaggtcatcacgcaacagaacgctatggcatcaaggcattaggcgaatggttggcgaaagaatatggctttgacgtagaatttaaagatatagataatccagcataaaatacaaaagtgcggtaaaaatatttcttttttaccgcacgctttcttctctataagatcctacaatcataactaataacaattagcttcctttaataaaagaaaaaattgaatgcccattaaaaataagcaacaatacccaaaaaatttcataatattaagtgggaacaaatatggagcattctgttcataacaaactggtttcttttatttggagtattgcagacgattgtctgcgcgatgtgtatgtgcgcggtaaatatcgtgatgtgattttaccgatgtttgtgcttcgtcgtttggatactttacttgagccaagcaaagatgccgtattggaagaaatgcgttttcaaaaagaagaattggcattcaccgaattggatgaccttccccttaaaaaaattaccggtcatgttttttataacacctcaaaatggacattaaaatccctctatcaaaccgccagcaatacgccgcagtatatgctggccaattttgaagaatatcttgatggtttcagcaccaacattcatgaaatcatcaactgcttcaagctgcgtgaacaaatccgccatatgtcccataaaaatgttttgctgagcgtgttggaaaaatttgtatcgccctatatcaatcttacccctaaagaacaacaagaccctgagggcaacaaattaccagcgctgaccaatctgggcatgggctatgtatttgaagaactgattcgtaaatttaacgaagaaaataacgaagaagctggcgaacactttaccccacgcgaagtgatcgagctgatgacgcatttagtctttgatccgctcaaagaccaaattccggccattattacgatttacgacccagcttgcggcagcggtggcatgctgaccgagtcgcaaaactttattgagcaaaaatatccgctatctgaatcacaaggcgagcgttccatctttttgtttggtaaagaaaccaatgatgaaacctatgccatttgtaaatctgacatgatgattaaaggtgataatcccgaaaacatcaaagtcggctcaacccttgctacagatagcttccaaggtaatcactttgactttatgctttccaacccgccatatggcaaaagctggagcaaagatcaagcctatatcaaagacggcaatgaggttatcgacagtcgctttaaagttaccttaccagattactggggcaatgtagaaacccttgatgctaccccacgctccagcgatggacagctgctattcctaatggaaatggtcagcaaaatgaaatcgccgaatgacaacaaaatcggcagccgagtggcctccgtgcataacggctcaagcctgtttaccggcgatgcaggttcaggagaaagcaacattcgtcgccatattattgaaaaagatttgctcgaagccatcgtacagctgcctaacaacctgttttataacacaggtattaccacttatatttggttgctgtccaacaacaaacctgaagcacgcaaaggcaaagttcagctcattgatgccagcctcttattccgcaaattgcgtaaaaaccttggcgataaaaactgcgaatttgtacctgaacatatcgccgaaattacccaaaactatcttgatttcactgccaaagcgcgcgaaaccgacagccaaaatgaagcagtcggcctggcttcgcagatttttgacaatcaagatttcggctattacaaagtcaccatcgaacgcccggatcgccgttctgcccaatttaccgccgaaaatatctcgcctttacggtttgacaaggctttgtttgagccgatgcaatatctttatcggcaatatggcgaacaaatttacaacgccggatttttagcccaaaccgagcaagaaattaccgcttggtgcgaagcgcagggcatagccttaaacaacaaaaacaagaccaagctgctggacgtcaaaacctgggaaaaagccgccgcactttttcagacggcatcaaccttgctcgaacatttcggcgaacaacaatttgacgatttcaaccaattcaaacaagccgtggaatgccgtctgaaagccgaaaaaatccccctttctgccacagagaaaaaggccgttttcaatgccgtaagttggtacgacgaaaattcagccaaagtgattgccaaaacactcaagctcaaaccaaacgaattggacgccctttgccaacgctaccaatgccaagccgacgagctggcagactttggctattacgccaccggcaaagcaggcgaatatatcctatatgaaacgagcagcgacttgcgcgacagcgaatccataccgctcaaacaaaatatccacgactatttcaaagccgaagtgcaagcgcacatcagcgaagcatggctgaatatggaaagcgtaaaaatcggctatgaaatcagcttcaacaaatacttctaccgccacaaaccattacgcagccttgcagaagttgcccaagatattttggcgttagaaaaacaggctgacggcttgattagtgaaattctagaggcttaataaaaaacaaactattaagcaagttttaataggtcttaagtaaggaaattcaaaatatataacacattgaaaaataatgaattttaccttttaagcaagatttggcatgaaataagcaaggaataataatgacagaaccgctttctaaaattaacggcattatcacaaaaaattatttagagatgcagccggaaaaccaatattttgagcgcaaaggactaggagaaaaagacatcaagccaactaaaatagctgaagaattagttggaatgctcaatgctgatggcggagttttggcttttggtgtggcagataatggcgaaatccaagacttgaatagccttggcgataaattagatgattatcggaaattggttttcgattttattgcaccgccttgtcggattggactggaagaaattctggttgatggaaaattagttttcttattccacgtagagcaagatttagagcgtatttattgtcgcaaagacaatgaaaatgtgttcttacgtgtagcagatagtaatcgaggccctctcaccagagaacaaatcaaaaatcttgaatatgataaaaatatccgtctatttgaagatgaaatagttcctgattttaatgaagaagatttagatcaagaattattagagctatataaaaagaaagttaattttacctccgataatatcttagatttattatacaagcgaaatttattaaccaaaaaggaaggttgttatcagtttaaaaaatcagccattttactcttttctaccatgccggaacgttacattccttcagcatcagtccgctatgttcgttatgaaggtacagtagcgaaagtcggtactgagcataatgtgataaaagaccaacgttttgaaaataatattccaaagctaattgaggagctgacctattttttaagagcctctttaagggattattactttcttgatgtcaatcagggaaaatttatcaaagtaccggaatatcctgaagaagcttggttagaaggtgttgtaaatgcgctttgtcatcgttcttacaatgttcaaggtaatgttatttatattaaacatttcgacgatcgtcttgaaattagtaatagtggccctctccctgctcaagtcaccattgaaaatattaaaacggaacgattcgctcggaatccacgtatagcacgagttttagaggatcttgggtatgtccgtcagcttaatgaaggcgtttcccgtatttatgagtcaatggaaaaatcattattggcaaagcctgaatatagagaacaaaacaacaatgtttatctaacattgcgcaaccgtgttaccgcacatgaaaaaacggtatctacagccactatgctgcagattgaaaaagaatggacaaactacaacgacacccaaaaagccattttgctttatctatttacaaatggtacggcgatattgtcagaattagttgactatacaaaaatcaatcagaattcgatccgagcgtatttaaatgcctttattcagcaaggtattattgaaagacaaagtgtaaaacagcgtgaccccaatgccaaatatgcttttagaaaagattaagcaaggtttatcgcttgctaagcaaggaaattgacaatgcttaacttgctgaaaaataatgatttttatcttttaagcaagatttggcatgaaataagcaagtttttttatagttaaacggacaacaaattgcatcaataagagcggtcatattttaaggattttttgcaaatgagacgatacgagcgttacaaagattcaggtgtggattggctaggggaggtaccgagccattgggagttaaaacgcttgaaacaattatttgttgaaaaaaaacataagcaaagcctgtctcttaattgtggagccattagttttggtaaagttattgaaaaatcggatgataaagtaacagaggcaacaaaacgttcatatcaagaggtgttaaaaggcgagtttttaataaatcctttaaacttaaattatgacctaattagtttgagaattgctttatcagaaatagacgttgttgtaagtgccggttacattgttttaaaagaaaaacaaataattaataaaaaatacttttcgtatttattacatagatacgatgttgcatatatgaaattattaggttcaggtgtaagacaaacgattaactatgggcatatttcagacagtattttggttattccacctctctccgaacaacaaaaaatcgcgcaattcctagacgataaaaccgctaaaatcgatcaggcggtggatttggcggaaaagcagattgccctgttgaaagagcacaagcagatcctgattcaaaatgccgtaacccgaggcttaaaccctgatgtgccgttaaaagattccggcgtggaatggatagggcaagtgccggagcattgggatgtgcaacgttcaaaattcattttcaagaaaatagaaagaaaagtgaatgaggaagaccaaattgttacttgttttagggatgggcaagtaactctgagagctaatcgaagaactgaaggatttacaaatgcgctaaaagaacacggctaccaaggaattagaaaaggtgatttagttattcacgctatggatgcttttgcaggggcaattggtatttctgattcagatggtaaagcaacaccagtttattccgtttgtttgcctcatgataaacaaaaaatcgatgtctatttttacgcttattacttaagaaatcttgcattatcaggatttattagctccttagctaaaggaattagagagcgttcaacagattttcgctattctgattttgcagaattattactacctattcctccatatttagaacagcaaaaaattgccgactacctagataaacaaacctctaaaattgatcgagcaatcgcattaaaaacagcccatattgaaaagctgaaagaatataaaagcgtgttgattaacgatgtggtgaccggcaaggtgcgggtataggtgtgaaaagtgcggtcaaaaaatccgatggattttgaatatcggcgcgacaacttgggcgtaatgaataaatttaaaaaattcacaaaagggtgaaaaatggtttcaggaactaaggaaaaagatttagaaattgccatcgaaaaagccttaactggcacttggcgtgaaaacatggaaaataagctgggcgagccgaaggctgaatacctgccgcgccatcatggttttaaactggcattttcacaggattttgatgcgcagtttgccatcgacacacgtctgttttggcaattcctgcaaaccagccaagaggcagaacttgcccgttttcaacaactcaacccaaacgactggcagcgtaaaattttggagcgattagaccgccaaataaagaaaaacggcgtgttgcacctgctgaaaaaaggcttggatattgatagcgcccattttgatttgctctaccccgttccgcttgccagcagcggcgaaaaggtcaagcagcgttttgaacagaatttgtttagctgtatgcgtcaagtgccttattctgcctcaagcaatgaaacggtggatatggtgctgtttgccaatggcttgccgattattgcccttgagctgaaaaaccattggacaggtcagacagccattgatgcgcaaaaacaatacctcaaccgtgatttaagccaaacgttgttccatttcgggcgttgtttggcgcattttgccttagatacggaagaagcttatatgaccaccaaattggcggggcctgctacgtttttcttgccgtttaacttgggcaacaactgcggtaagggtaatccgcccaatcccaatggacaccgcacggcgtatttatggcaagaggtgttcggcaaagcaagccttgccaacattattcagcattttatgcgcttagacggttcaaccaaagatccgttggataaacgtaccctctttttccctcgctatcaccaattagatgtggtccgccgtttgattgctgatgtcagtgaacatggcgtgggtaaacgttatttgattcaacattctgccggttcgggcaagtctaattccattacttggctggcgtatcagttgattgaggcatatccgcgcaatgaaaaggcggcaaacggtagagaggcagaccgcccgatttttgattcggtgattgtcgtaaccgaccgtcgtttgttggataagcaactgcgcgacaatatcaaagatttttcagaagttaaaaacattgttgcgccggcgttgagttcggcagagttgcgccaatcgcttgagcagggcaaaaaaatcattattaccacgattcaaaaattcccgtttattgtcgatggcattgctgatttaggcgacaaacaatttgcggtgattattgatgaggcacacagctcacaatcaggttcggcacacgacaatatgaaccgggccatcggcaaaacggaagaccttgatgctgaagatgtgcaagatttgattttacaaaccatgcaatcccgcaaaatgcacggcaatgcgtcgtattttgctttcaccgccacaccgaaaaacagcactttggaaaaattcggcgaaaaacaggcggatggcaagtttaagccgttccacctttattctatgaagcaggcgattgaagaaggctttattttggatgtaatcgccaattacaccacctataaaagtttttatgagatcactaagtcgattgaagataatccggagtttgatagtaaaaaggctcaaagccgtctgaaagcctatgtggagcgttcgcaacaaacgattgatactaaagcggagataatgctggatcattttatttaccaagttttcaaccgtaaaaaactcaaaggcaaagccaagggaatggtggtaacgcaaaatattgaaaccgccatccgctattttcaggcgttaaaacatttgctggccgggcggggtaatccgtttaaaattgcgattgcgttttcaggcagtaaagtggttgacggtgtcgaatacaccgaagcggaaatgaacggctttgcagaaagcgaaaccaaagagtatttcgatcaagatgaatatcgtttgctggtggtcgccaataaatatctgaccggtttcgatcagccgaaattgtgtgccatgtatgtggataagaaactctccggcgtgctttgcgtgcaggctttatctcgtttgaatcgcagtgcgaataagttgagtaaacgcacggaagatttgtttgtattggacttttttaacagcgttgaagatattcagcaggcatttgagccgttttatacttctacttcgttgtcgcaggcaaccgatgtcaatgtcttgcatgatttgaaagaccggttggatgaaaccggcgtgtacgaacaagcggaggtcaacgattttactgaaggctattttgccaataaagacgcacagcaattaagcagtatgattgatgtggctgtccaacgttttgatgatgaattggaattggatttggatcgaaatgaaaaagttgattttaaaatcaaggcaaaacagtttttaaaaatttacgggcaaatggcctccatcatcaattttgaaaatatcgcttgggaaaagctctattggttcctcaaattcttagtacccaaattaaaagtacaagacccgatggatgaatttgatgaaattttagatgcagtggatttaagctcttacggcttggcgcgcaccaagctgaattacagcattaaattagatgatgaagaaacagagcttgacccgcaaaaccccaatccgcgcggtacgcatggtgaagataaagaaaaagatccgattgatgaaattattcgtgtatttaacgaaagatggtttcaagattggagcgcaacgccggatgagcaacgggtaaaatttatcaatattaccgagcgcatccgcagccataaagactttgagcagaaatatcaaaataacccggatattcatacccgtgaattggctttccaagccattttgcgcgatgtgatgagcgaacgccatagggatgaattagagctatacaaactttttgccaaagatgccgcatttagaaccgcttggacgcaaagtttgcaacgggctttggctggatagaaaagattgcctgaaaaattaacgttcggctctccttttctatctaaattaatatcatcgtaaacattaattaattttttcacatacttaaaagagaaaattaaatatagtttccataacagcaacgtcgttaattagaataatttataaattagctataattcataaaacacaaaagtgcggtaaaaatatttcttttttaaccgcacttttatcttctgaaattatcgtttaaacattccgcctaaaccgcctaagcctccgcccattaagccttgcattccacgcatcattttagccatgccgcctttacgcattttcttcatcatacgttgcatttcatcgaattgtttaagtaatttattgacatcttgcacttgagtgccagaacctaatgcaatacgacgacggcgagatcctttgataatatctgggttggcacgttcttttagggtcatggagttaatgatcgcttccattttgacaaacattttgtcatccacttgatttttaacgtgctcaggcaaattttttgcacctggtaatttctcaagcatagacatcatgccacccatttttttcatttcgatcagctgttcgcggaaatcatctaaagtgaaatcatcgcctttcttgaatttctgcgccattttttccgctttttcacgatcaacagaacgttcaagatcctcaatcaatgaaagcacatcgcccatgcccaaaatacgggaagcaacacgatcaggatggaacggctcaagtgcctccgttttctcacccacacccaagaatttaattggtttacctgtgatttgacgaatcgataacgccgcaccaccgcgcgcatcaccgtccactttcgtcaaaataacccctgtaagaggcaatgcttcattaaaggcttttgctgtatttgccgcatcttgaccagtcatcgcatcaacagtgaaaagggtttcgattggatttaatgcagcatggacttgcttgatttcgtccatcatttctgtatcaacgtgtaggcgacctgccgtatccacaatcaacacatcgtagaatttcagttttgcatcagcaagtgcctctttagcaatatcaacggggttttgtttaacatccgatggaaaaaaatccacgccaacggattgagccaaggtttcaagttgcttaatcgcagcagggcgatatacgtcagcagacaccactaacactttctttttatggcgttcacgcaagaattttgccaatttacccacgctggtggttttacccgcaccttgtaaacctgccattaagataactgctggtggttgggttgcaagatttaaactttcattggcttcgcccatggctttttcaagctcacgctgaacgatttttaagaactcttgccctggcgttaaacttttattgacttcttccccaagcgcgctttcttttacttttgcgataaattcacgcaccacaggcaaggcaacatcggcttcaagtaatgccatacgcacttcgcgcaaggtttctttaatattatcttccgttaaacggccttttcctgtgatattacgtaaggttttggaaaggcgatccgataaattctcaaacatggctaacaatcctgtttttcttaaaaaattgtgctgattataccgaaatttaggcgtttttcatcatttcaaatgaaaatggatttttgagtaggcaatttcatgaagaaagcataggagataaggaaaaagaatgattatttagccaatttcaggtattattctgcccactcttggctatttgagcagctatttgatttagcaaaatcaaataacaggtaaaaagtgcggtgaaaaatgaccgcactttttgttgattaacgaacaaaaggattttcccttggatagcattccccttagtactttatttattattcttattatctgtttagttttatcagcctatttttctggttctgaaactggactactctccctcaataaatatcgtcttcgttttctatctgaacaaggcaataaaggcgcgaaaaaagcggaaaaactgctagaaaagccagatactttgttaagttttattcttatttttaataaccttgtgaatatcagcgcatctgcaattgcaacagtaattggtatgcgtttatatggcgatgctggcgtggcgattgcaacgggtttgctcactttcgtaatgcttgtattttctgaaatattccccaaaacggtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtgtcagaagcaggcgaagcaacaccaaatgaacaacatccacaaatgttgctgtctattttggatatggagacagtcactgttgatgacattatggttccccgcaacgaaatcggcggtataaatattgatgatgattggcgagctattatgcgccagctcaatcatgctgcacataaccgcgtggtgctttacaaaggcagccttgatgaacaagtgcttggcattttgcgcgtgcgtgaagcattccgcttactgcttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaatcataaaaaactccgccaaattgaaccgcacttttgacttggatcataagtgcggttctttttttgcgcattttttagaaaagatttttataattctttctaggtatattttgatagagaagaaagatatggaacacgaatatcaacgggcggtgactcgcgtgtgcgtacaaacggcactgctcttgttacaacatggggcagaaagtaccgtggtggtgcaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgtacaaagaaaactggatcaattaaaaccgcttaaatataaccgatggttagttgtattcatgattggcttatcttgtgcagcattcgcccatttatctggcggagactggataatttgtagcattacctttgtggcagccgccattgccatgtttgtgcgacaagaattttctaaacggcactataatccccttatcgtcttttccatcacctctttcgtcgcctctctgatttctggcgtgagcttaaaatataacttaggtaacgatcctcaaattgctttagcgtctagtgtgttattacttgtgccagggtttcctctgattaattctttggcggatatattaaaaggttatgtgaatatgggattaggccgttggacgattgcgactgttctcacttttggcgcatgtcttggtattgtattcgctttaagcctattacatattacaacttgggggcattaaaatgttatcagacatcacaatatttatcttgaaattactcgatgatatgctatgtgctgcgattccagcggtgggctttgctttagtatttaatgtgccgcccaaagccttaaaatattgtgcaattttagccgcacttgggcatgttacacgcacattattactgcatattaatatgcctattgtatttgctacattctttgccacttgtgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattagctttaccaggcttattgttttatcgacaaaaacctgtggtgtaacactaaaaacagtgcaacaaaaaagccgacatttgtcggctttctactattcttgtgattttttcttgaggtattcataaagctcatctttaatccgtaatttttcttttttcaaataacgatttccattttgtaatcaattcattatttaatgtttggcgcgcttgattattcacataacgaatgtattccacaaaaagttgatcctcttctttacgatcaaaagaggatagaattaattgattaagattattttcttgagaaaacttaaaatgtgaggcaatttgctgaacagtttcattttcaactttagctctcgctttcacaaaatcagattgatttaaaaaagccactaattgagcggatgaagtaagaatttttgtaaattcatgatacgcagaatctgtcgccttacgctcaatttttaccatatcaacggcatcagcatcaccactaactaaatggggcgtggattctaatacaaagtgcggtcaatttttctttatttttatacgttggcttttaaactggtttatttgaagaaagcacgctagaataagattgttttcatttcaacgaaaaaagtaaggaaattctatgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagtgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcatacatttgattttgaagtgaaagatcatatcactttgggtgaagaagcaaatggcttagattttgctgctggggctaaattagctggtgcgcgttttgccgtaatgaaaggtcaaatcgctaaaatgcaccgcgcattggcacaattcatgttagatcttcatactgaacaacacggctatttagaaacctatgtgccttatttagtaaatcacgcaacactttatggtacagggcaattaccaaaattcggggaagatttattccatactttagccttagaaggcgaacaaccttacgcattaattccaaccgcagaagtgcccgtcactaatttagtgcgtgatgtaattattgatgaagcagaattaccaataaaaatgaccgcacatacgccatgtttccgttctgaagctggctcttacggtcgtgatactcgtggtttaattcgtatgcaccaatttgataaagtagaaatggtacaaatcgttgatccagataaatcaatggaagcacttgaagaattaacaggtcatgcggaaaaagtattgcaattattaaatttaccataccgtaaagttttactttgcacaggcgatatgggctttggttcttgcaaaacttacgatttagaagtttggctgcctgcacaaaatacttatcgagaaatttcttcttgctcaaatatgtgggatttccaagctcgccgtatgcaagctcgctgtaaagcaaaaggcgataagaaaactcgcttagtgcacacattaaatggttcaggcttagcggttggtcgtactttagtggctgtacttgaaaactatcaaaatgccgatggttcaattaccgtgccagaagagctacgtccatatatgggcggattagacgttatcggaaaataatccttctagaagataaaaaagcgtggattttaaaatttccacgcttttttattatcaaagccttacaataactgttttaaattttttggcattcaagccaattaggaactttattctattataaaattatatctataacatagaaaatttatctttcaattgacatcaatatccagagcattactctaaaaaacatatcaaagtatctaaattgttataatattagttcactttacgattaaacaatagtaagaagcaattttaataagttagatattccacgtataaaacagtataattccatcaatagatcataaaccaacaggagtattttatgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaagatatttccgttgcagatgcctatctttacattatgctcaattggtgtcgagcagtgggtatagatttcagccacttaacacaactttcggcttttatgcaacgtgttgagactgatcaagctgtcgaaaatgtgagaaaaagtgaagaactaaaagtataaacaggaagtttctacaaaaattgcccgtttttaaccgtttgtatcacgttaagtttaaatttaagtgagtaatttcgcttcttacccaacacagctaaccaattgattctactatgattaaactggttaatccaatgtcgcaatgttctactgtcaagttgaaaatgtttactgatgagtgaataatttttaccattttgaatataaaattcgatgacttgttgtttgaaaagagtgttgtatttggctataaaaaatctgcatcttacaattaatttatataagtaaaaatatcttgcttttatcatcgttaaacttagaataaatataaataattatcattaagatttaagggtatatatgaatattttaattaataaacgtatctttttattagttacccttgtaggtattcaactaaatgtaaccgcaaaacaaaattcttctaattctaatagagaggagttattacctattattgtgaacactaatgatgatagtaataaactacctggtcgttcagtattaaaacagaaaaatatcgaacaacaacaagctgataatgcagcaaacttaattaatatcttaccaggtgtgaatatggctggcggatttcgtcctggtgggcaaacattaaatattaatggaatgggtgacgctgaagatgttagagtgcagttagatggggctacaaaaagttttgaaaaataccaacagggttctatttttattgagcctgaattattaagaagagtaacagtagacaaaggaaattattctcctcaatatggtaatggtggttttgctggaacagtaaaatttgaaactaaggctgctagggatttcttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattttagaataaatagcccgattgaatctaatcgggctttatcataactataattaagcaaaacctaactataatgtccattatacaagattaatcataaatatacttttttgaaaaaaatttacagaaaatttatcttaatataggagatatattaagataaatacatcattaaagaatgtagagataataggtataatcccctatactaattttagtattctttgaagagcaaatttaaataataaatccaaaataaatacaatatctgaaattatagatgagtattaaaattatattttatctttaccctattactattcataatagaaactaaactcacctaaaaatttaaatataatttaatgtctagtctaacaacaaagccaacgcatatttattcttgtttttctttctttccgattaatatcattagttttcacaaatatcactattcaaaacgacaccttatgtcttactaacttttctaatataagaatatcattagaataaactattaagaagaaagttaaagctccagtattatgtaacaagttattaataatttgatataacttttcatataaaagcaatgtacctttataacataattacaatgtatcctgttataaatttatagcaatgtcctaaatagtaaagagtacgaacaaaatacatataggttattaattactttaaaaatattagaatatatttatagatttaggaataattacatttatctatcaaagtatggttaatctagagaaattttttacagcaatacaacaaccttacaaagaattcaaatattctgatttttaggaaaaaacaaaaaccctagtttttcaactggggttattttttctttatctaatttttttaattttaattctgtttttacttaatttaattttatctgtcttagatagatttatatttagatttttatttggtaacccggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttcctctacctttcactcgttcttattggtcacaagctgaactcaattttctttctattaagtcttctatacttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagatttttttacaaaacaggtttgtttttagagtttccttttcagttctctctttcactttcctgtcttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcccaggttaagcccggggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagcttcctcctgctaccgttcgacttgcatgtgttaagcctgccgccagcgttcaatctgagccatgatcaaactcttcaattcaagttcaatcgctcaataaactacttagctataaatagaaacactacttaaaaaagtaatgatgaattttcagttaagcacctattaagacttcaaaattaaaaaatatttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcttataaagataagatggggtggctaatgggattcgaacccacgacaactggaatcacaatccagggctctaccaactgagctatagccaccattaaaagttgttattgcactgacctggcgcgctcgacaagattcgaacttgcgacctttggctccggaggccaacgctctatccaactgagctacgaacgcgttactgcgtcgtcgttgcgggggcgtatattaatgatttcataaaaccttgtctagcactttttgaaaaaaaatgtttgagcgatagttttttattcagtttgtttaaaattcactattttttcgactatttttacaacttggcaaatcattatatatgttgaatcatccaacaattatgaatttgtttattacgttcaaaatctaacggtaaggttttatgcgaaatttctaccgcacttaaacctaattcttccaacgcaactaaattcattttgaatccacgtttattattcgagaaaacaattgtgccattattcgacaaaactcgttttagattgcgcattaatttcacatgatctcgttgcacatcccaactgtcttccatacgtttagaatttgaaaacgtcggtggatccacaaatatcaaatcaaattgacgatcacatttttctaaccattgaaggcaatctgcttgaattaatttatgttgtttaccttcaatatcattcaaaataagattttgctccgcccaattaagataagtattggacatatcaacggtcgttgtcgatttagcgccaccaagtgccgcatgaacagttgcagaaccagtataagcaaataaatttaagaaatctttaccttttgccaacgctccaatcatttttcttgttaaacggtgatctaaaaataagcccgtgtctaaataatctgtcaaatttacccaaagctgcgcgccatattcattcacataaaagtattcgcctttattggctaatttctcatattggttagtacctttttgtttctgacgaactttgaggatcaacttattcgtttctacacctgtaacgtgcaaagttgcagtaaccgcatctaacaaacgctgacgcgctttattttcatcaatatttttcggtgctgcatattcttgcacaacaatgtaatctgcataacgatcaacggctaaattatattctggcaaatcggcatcatataaacgataagcgtctaatccttgttgctttgcccatttactaattttcttaatatttttttgtaatcgattagcaaaatcggttgcaacctccgaagtgcggttaaattctagttcattttcagcggtaatttcgtcagattttcgttctgaaacttgataattcttctgcacacaatctaatgggccatttttggctttaaactgtcggctggcacgcattctcaaacaatcaagtaatgtggattcgctactaaaaacagaaacattccaaccacaaaattcttttttaagtctttgcccaaatacagaatagagcgcgatcaatgctggggttgtgcctaagcgttccccataaggtggattacagataaccgtaccgacttcatttaaacgaggatttttcaacgctgcaacatcaccttgctgccatttaattaaatgtgaaacacctgcattttgtgcattcttttgcgccttttttaatacgcggtgatcgaggtcaaatccataaaagtgcggttgaatttcacgttgtttttcttctgctaattcaatcgcttcattttttactttttcccaagccgattgattatgcgctttccaaaaatcaaatccccaatgtaaacgataaagttgcggtgcaattttggcttccatttgtgccgcctcaattaaaagcgtgccagagccacacattggatctactaatggagaacccacttgccaacctgaacgcagaacaattgccgcagctagagtttcacgtaaaggagcttgacctgcatcttcacgatagcctcgtaaatgtaatgcttccccacttaaatctaaagaaatcactaaattttcacgattcaaataagcatggatacgcacgtccggctgaattttatctacatcgggacgagctttaccttgacgttcaaagtaatcgacaattccatctttaacgcgcatcgcaccaaattgagtatgacgaatttcttggttggttccattaaaatcgacaaagaatgtaactctttcatcaaatagccctaaccaattaaagcctgaaacagccgcataaagatccaaatcactgtaaattttagtttcaatcaaaggaaataaaatgcgtgaagcaaggcgtgaccaaagtaaagtgcggtataaagtttcgtcatctgcttgataatgaacgccaccttgaaccacttttgcctcttgcgcaccaagttcagtgagttcaacttttaataattcttcaaagccacgagaagtcgttgcaaataattgtttcatttaggtaccgattttgaaaattttgagggattatagcatagaaaaagatgatctaattgagatcatcatagcgagttaaactgtaaaaagaaaagccctgattttctaaatcagggcttcaaaatttgctggttgcgggggccggatttgaaccgacggccttcgggttatgagcccgacgagctaccaagctgctccaccccgcgtctgatgaggcgtactatactcgcttaaaatttaattgcaagaattaaacaaaactttatcaattgtttgttaataaaatgttcaatgtgtagttttattaagcaatttcactaaataacactggttgttttctgtaaattttgatagcgtatgcgaccttatttctgcttactttaggattgaaaatgtcggtgtgtaaaccattttggttcaaaactttttctatctcaattattaccgcacttttggtgtcttgtacctctaacataaaaaacattcagattcccaccaccttaaatggtagtgatcctcaacaattcggtgcaaaatataccaatcgaacttatcagcaagcagcgcttgtgcctgtatccaacatagaaaaccaaagtgcggtaataaatcaaggcgattttttaacacagctttccaatataaaaaattattcgagtaaactttccaccaatttttacgacaattatgaaaagattacaaattgggttctttctggggcaaatattaatgaactcactcaatttaatatccatccgcaaattatgcgtggatttgatgggtatcaaaatgtactgatgacaggctattattcgcctatactttatgctcgtcataccccacaaggtcaatttaaaaatccaatttatcgtatgcctgtaaaaaaacgtctaagtcgagcacaaatttatgcgggcgcattaacgggaaaaagattagagttagcatatagcgattcaatgttagaaaactttttacttggtgtacaaggcagtggctatgtagattttggcgatggtaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtgtacaaagcttgttagaacgcaatgaagcttatgtattctttaaaaatgatccaagtggcaaagtgaaaggctctgcgggcgttcctcttgtagcaatggcttcagtggcatcagatcgcaatattatcccgtctggttctgtgcttttagtcgaagtacccgacattgataataacggaaactggattggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaatggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatcttaatcacctcttgaaaatgcacattgaccataaatgtgcattttttattgaatgaaacctattgactttgaaaatgaaaaattttccctctttttactataaaatcgttgcaatttatataaaaaggcgtactcttttttccctttgagaattactaccaacaagtaaggaaacataaatatgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataaatctttctaaaaacaatgaccgcacataaaagtgcggtcattttctttgctaaatttgatatttagttttatctccaatatcaaaatgcaaaggcattcgccatttttgtatcgctaaaactaaaagtaatacgccagaaataatagaaaaaatgcgtagtgcaataagattatttaacacccacgaaaaccacaagcaagccacaaatatcggctgtaaatttagcaaaggcacgcggaaacaaaaatattctttaaaacacaagccacctaaagtaagtaacgcaccgccaagagccaacgcaggataatgattaatataaaaaagtaatcctatccaagtagcaaattgaaaaagcaatcgaaaagattttaagtaaatgtgtaacgaagaggcacaacaggttgccgcaattaatataaatgtgagtgataaatctggataccaactcactgtaagaacagccaacgccgctatcacaaaaccagttcggtaaataataacagtcagataatctaaaaaatccatcggtgatttaatatgtggatcagccattgtataaatgttcctttttatgaattacaaattaaaaataaatatagcctaaaagtcagaaataaaaagtacagtcaatttagaaacaggttctaaattaaccgcacttttattatttcagttttagcttatcaagaattttttgatgaatgccaccaaaactgccgttagacatcactaaaatatgatccgtaggttgagcctctgcaacaatcatatccactaatcgatctaaatttgcattccaataagcaggttgtacacattggtttgcaatatctgccacttcccaagaaagttgttcaggttgaagcataaacacggcatcagctcgaccaagtgcaggcgcgatgtcatctttgtgaacacccattttcattgtgttagaacgaggttcaagcactgcaagaatacgaacaccaccaactttatctcgtaaagcggttagcgtagcaagaatagcttctggatgatgagcaaaatcatcataaaccgtaatgccattaacttcacctttcacttctaaacgacgtttagcattcacaaaagatcccaacgctttgcacgcatcttcaatagcaacgccagtatgatgagccgcagcgatcgccattaacgcattatgcatattatgttgtcccactacattccattttacttctgccactttttctccatgatggaagacagcaaaatgtgaagcatcatttgtaatacgttcagcaaaccactcgttatctttgcctaaaaattgctgttgagaccaacatcccaatgccaaagtttcttttgcactttgttcactcgccgaacttaataccaagccactggctgggatagttcgaatcatatgatgaaattggcgttggatcgctttgagatcatcaaaaatatctgcatggtcaaaactaatgttatttacgataagtgtacgaggattgtaatggacaaatttcgaacgtttatcaaagaaagctgtatcatattcatcagcttcaataacaaaataagggctatctcctaaacgagctgaaatgccaaaattacccgcaattcctccgattaaaaaacctggttttaagccattttgttctaagatccacgttagcatacctgttgtggttgtttttccatgcgtacctgaaatcgccaatacccaacgatctcgcaataaatgatcatgtaaccattgagggccagatgtatatttcaaattattttccaacacatattctacgcaaggattaccacgtttcatcgcattaccaacaattaccatatcaggcgcaggttgtaattgtgcaacatcataatttggaataatctcgataccttgctcttctaaaaaagtgttcattggagggtaaacattagtatcggaacccgttacgtgatagcccatttgtttagcaatcatcgccacaccgcccataaatgtgccacaaatacctaagatatgaatatgtttcattgtatttctctgttgattaaggaaaacgaaaaatatgataaaacaacttctatgaactttcaaaagaaaagaccatcataccaaactatatgatctataattaacgccactgaactattatttaaccacttcaataggaataaacaatgaaatttaagcgataaaacaatttcagaagcacaatagctcactatttacaaagaaaataatcagccgttctatgtagcaaatcttcctgcattacaatttggaaaaagtattcaagtcgatattattgggacttcaattcattttgctgacggtacccaaattggtttagtttcagaacaaaaataatcctataaaaaatgcctgtgtaaaacaggcatttttttatccgcacttttaagcaattcgctcaaaaccagctttcaaatctgcaattagttcatccacattttcaaaaccaatatgcacacgaattaatgaacctgtaagattacgtttaatatttggacgaatatgtgcaatttcttctggttgattacaaagaattagagactcaaatcctccccatgaataagccatagcgaacagttgaaaatgatccataaattttgatacttgctctgaagttaatcgctgggttaattcaaaagaaaataaaccactgcttccactaaaatcacgtaaaaagaattcatgaccagggcaacttggtaaagctggatggtacacagtttttacttctggttgctcactcaaccattttgccactttaatactgctttcctgatgttgttttaatcgtacccccaatgtacggataccacgagcagtcgtataagcagaatctgcatcaaccatttgccccattaaataggaatgttctctaagttgatcccaagttcgcgcattcgcaacggcagtaccaatcataatatctgaatgacccactaaatatttcgtacccgcctgaatagaaatatcaatatcatgctctaacgctttaaatagaacacctgccgaccaagtattatcaatcataatcacaatattagggttcacctttcttgcagccttcacaatagtcggaatatcgggaatttccattgtaatagaactcggtgcttctaagaaaagtacttttgtattcggttgaataagcgttgcaatatccgcaccaataagaggatcgtaataagttatatcgatctgcatttttttcagcacaatattacagaaatattgggttggctcgtaagctgcaccactcattaacacatggtcgccagttttaacaaaagaaagaatcgaattagttactgctgctgtaccacaaggataaagataacaacctgcccccccctccatttcgcacattaaatcttgtaaagcaaaatgtgttagcgtccctcttctgccataaaataattcgccttttgctctacgttgagtagcgtgttttttatcttcaatactgtcaaatagtaatgaagaagctcgctgtaaaacagggtttaccgatccttgtgaaaaacgtttttgacgccctgcatggacaaatgttgttgagagattgtgttgttgcatatttccaccttattttagataagattaattgctttaatagataaaatcgagtataaaatgtcggcgtttcaaatagaatcgcaccgctattttgtgtggcaaaactttaacttaactttatataggaattatgactatggtattagtaacccgtcaagcaccagattttacttcatctgctgtattaagcaatggcgaaatcgttgataacttcaactttaaaaaacacattgctggaaaagctgcagtaatctttttctacccattagactttacctttgtttgcccttctgagttaatcgcatttgaccaccgttatgaagaattcaaaaaacgtggcgtagaagtagttggtgtttctatcgactctcaattcactcacaatgcatggcgtaacaccccaactgaaaatggtggtatcggtcaagttaaatatgcattagcggcagacgtaaaacacgaaattgctcaagcatacggtattgaacatccagaagcaggcgttgcattacgcgcttcattcttaatcgacaaaaatggcgttgttcgtcaccaagtagtaaacgatcttccattaggtcgtaatatcgatgaaatgttacgtatggttgatgcattacaattccatgaagatcacggtgaagtttgccctgctcaatgggaaaaaggtaaagaagggatgaaagataaccctgaaggtgttgcaaaatacttaaaacaaaacgctgataaactttaatccgtaattatttacaagaaagccacataatgtggctttttttatattcttagatactttagaataggcatatctctaacaccaagagcggttcatttctatgaaattcaatatcccaattttcctaacgatctttcgagtcattttgattccttttttcgtgattgcattttatttacccattgaatcatctcctttcatcacaacactgattttttttattgcaggtgtcactgactggctagatggctatctagctcgtaaatggaaacagaccacgcgctttggtgcatttcttgatcctgttgctgataaagtaatggtagtggctgcactagttttaattgtcgaacatcaacatacattttggataaccattcctgccattattatgatttctcgtgaaattatcatctccgcattacgtgaatggatggcagagcttggggaacgtagcaaagtcgcagtctcttggtggggaaaatggaaaaccacagcgcaaatgttagcactaggcggattattatggcgttataacaactatatggaaatagcagcaattatcttactttatatcgccgctattttaactatatggtcaatgatccaatatttacaagtagcaaaaggaagcttgctagataatattcaattataaatttaaataaaacacagttattttttatgataaccatctatatttgagttatttttaatcaaataaaatattttttatttttttcgtttgacagcaatatataaatccgtaaaatacgccccgttgtcacgtagcagtgctgattagtgataaatgcgggaatagctcagttggtagagcacgaccttgccaaggtcggggtcgcgagttcgagcctcgtttcccgctccaatttgcccgagtggtggaatcggtagacacaagggatttaaaatccctcgcctttcgaggcgtgccagttcaagtctggcttcgggcaccatttaaacaccaatcaaaagatttgaaaatttattttaaaatcatctaattgggtcgttagctcagtcggtagagcagcggacttttaatccgttggtcgaaggttcgaatccttcacgacccaccactttaaaaataaagtaagcaccgaaaggtgtttttttattatctaaatctctgaaactcatataaaaaatccccgactcaaagaatcagggacttttacaatcaaacgtctttaattaacgctcattccaacgtttaatagactcacgaatcacttctttcgcttcttctacatcgccccaatgggtcactttcgttgagccaggtttcttaagcgctttatagttattgaaatggaactcaatttgtttaattaagtttgccggtaaatctgctaatgaattgtaggcatttcctgtatcacgatcatctgcaggaacacaaacgattttatcatccacttcgccatcatcaacaaatttcatgacaccaattactttagcctcaaggaatacacctgttgctaatggttggcgagtgattaataacacatctaactcatcgccatcttcatctaaagtttgtggaatgaaaccatagttagttggttttgcaaaaattgctggctcaacacgatctaactggaatgccgcaactttacggttccattcgattttatggcagctaccttctggaatttcatttactacattgataatgccagcatctacatcgcctggcgttaaaatttgattaaaatcagccattttgtttccttcattttatcaagttaaaaaacgtgacaagtatagcagtttttctgctgactcgcagtctcatttgtagagaaaatcagcaaatagattatttcataactattcataattttgaccgcactttatcctaaataaaactcacgcaaacgtttacttctcatttttatgatgtaaaatagcgcaccttattacttccaattttttacttaacttcaaggaacactatgccaactttagaaaaaacatttgaactcaaacaacgtggttcaactgttcgtcaagaaattatcgcgggtttaaccacgttcttagcaatggtttattctgtcatcgtggtacccaatatgctgggtgctgcaggttttcctgcggaatctgtctttattgccacctgtttagttgcaggattaggctctatcttaatcggcttatgggcaaatgcaccaatggcaattggttgtgcaatttctcttactgcttttacagcatttagcttagtgattggtcaaaaggtcgccattcccgttgcgctaggcgcagtattcttaatgggggttgtgtttaccttaatttctaccacaggtatccgtgcatggatcttgcgtaatttaccatccaatatcgctcacggagcaggcattggtatcggactctttttacttttaattgccgcaaacggtgttggtttagtcgtcagcaaccaagctggcttaccagtaaaattaggcgatttcacttcattcccagtcatgatgtccttgattggcttagcgttaattattggtcttgaaaaaatgaaaattaaaggcggcattttatgggtaattatcgctattactatcgtaggtttaatttttgatccaaatgtaaaatttggcggagagattttcaaaatgccaacctttggtgaaaattctctcttcttacaattagactttatgggcgcactacaacccgcaatcttgcctgtggtatttgctttggtgatgactgccgtatttgatgcaacgggcactattcgcgcagttgcaggtcaagcagacttgcttgataaagatggtcaaattatcaatggcggtaaagccttaacttcagactcaatcagtagcttattctcaggcttattcggtacagcaccagctgccgtttatattgagtcagcagcagggacagcagcaggcggtaaaacaggtattactgctatcgttgttggtgtgttattcctattaatgcttttcttccaaccattagctttcttagtgccaggctacgcaactgctccagcattaatgtatgttggtttattaatgttaagcaatgtaagcaaattagatttcgatgatttcgttggtgcgatgagcggattaatctgcgcagtgtttatcgtacttaccgctaacatcgtaacaggtattatgttaggttttgcggcattagtaattggaagaatcgtgagtggcgatattaaacgcttaaatgtaggtactgtgattattgcaatcgtacttgttgcattctatgcaggcggttgggcgatttagtaacagaaataagaaaagggaaaatccttccccttaattttaatcacaaaagtgcggtgaaattttaccgcactttttttatacgcagtactactctttcttcaataagaaaataccgtgatgaagttcacagtttttaaaattcaagtgaaaaaataaacgtgaaattcaccgcacttttctttataattgcgtgaattttccttacatcgaaacacgattatgtcaaatccctcttgtatcatcatcgccatcacaggtgcatctgcatcaggcaaaagttctatcgcttccactgttcacaaagagctctgtaatgaactaggctgccaagaaattggtatcattactgaagacagttactataaagatcaaagtcatttagaaatgactgagcgggtaaaaacgaattacgatcatccaaactctatggatcgcgatttacttatccaacatttaaaaaatctaaaaaatggcagtgcagtagatgtgcctgtttatagctatgtagaacatactcgcaccaacgaaacaacgcatttcacaccaaaacgaatcgtaattttagaagggattttattgctcacagacgaaagagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccatctaaacaatatgcggatattgtcattcctcgtggtggtaaaaaccgtattgcaatcaatatgttaaaagctcaaatccttcatttattgaatcaaaaataggaaatcttatgcgtctttgcgatactgatattgaacgctatctcgatgatggcattatttctttaacaccacgtccaaataatgacaaaatcaatggtgcgacaattgatgttcgcttaggtaattctttccgtgtatttcgtgaacactctgcacctttcattgatttaagtggcccgaaagaagaagtatccgcccagcttgaatcagtaatgagcgatgaaattcttattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgaattgacccaggttgggaaggaaaaatcgtgctggaattttataattcagggaaattaccattagcattacgcccaaatatggtaattggtgcgttaagttttgaagtattaagtggcgaagcaaaacgaccatacagtagccgcaaagatgcaaaatataaaaatcaacaaagtgcagtagccagtcgtattgacgaagacaaggaataatcaatgaaaaagttcgcgcttatcgtagggatcgtcgctttggcgatcttttcttttttatatattcaactttaccgcgtgcaaagtgctattaatgaacaactggcacaacaaaacattgccgttcagtcaatcaatttatcattattttctcccgcactttcccttgaaaatctaaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagaggtttcgcctttttcgttaaaacagcttttatcaaaaaaagtaatattaaatggcgaaaaccatattcgcattgaatttaataagcctatttatggaaaaacaaaaactttccatttttctttccataaagcgaatttagacttctcaacatcagaatcaaccccacttcaatttgtagatgcaagcctaaataatcagcctatcggttatattgaaagccacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaattttaagtggacacgccgattttgatcttgatttcagcttttcatcttccgcgcttattcaaggtaaattaaattttttagcgcaaaatggcgaaattcttggtgtgaatctattggatatggtagcgcaatatttcccgattaattacaacaatgatctgttacaaaacaaagaattaaacactcgctttgaacaattttacttgcaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaatgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaactgctgatactggtttaatgatgacagtttatgcttggacggtgctaattatgtctttaccagcgatgcttgccacgggcaatatggaacgtaaaagtctgcttattaagcttttcattatatttattgttgggcatattttattggtcattgcatggaatttctggatattacttctcgctcgaatgtgtattgcattagcccattcggtgttttggtcaattactgcctcacttgtgatgcgcatctcacctaaacacaagaaaactcaagcattaggaatgctcgctattggcaccgcacttgccaccatcttaggcttaccgattgggagaatcgtcggacagcttgtcggttggcgagtcacttttggcattattgcggtactggcattatccatcatgtttttaattattcgattattgccaaatttacccagtaaaaatgctggctctattgcaagtttacccttgcttgcgaaacgcccattattactttggctttacgtaacaacggcaatcgtcatttcagcacattttactgcttatacttatatcgaaccatttatgattgatgtcgggcatttagatccaaattttgccacggctgtattattagtttttggtttctcaggcattgcagcaagcctattatttaacagattataccgatttgctcccacaaaatttattgttgtttcgatgagtttattgatgttctctctattgctcctgttattttcaactgaagcaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacctttcttctgcaaaacaataaaaaaataaccgcactttagttctccaaaaagagttttaaaagtgcggttaaatctgtctaagttttatttatcttgcgtttaacgttttgctttcttaataaacttcatcaaacgtttacgtttacgcaattgattcggagtgagtttatttttgcgtcctgcaaatgggtttgagccttcttggaaaagcagacgaatcggtgaaccaataatttttaagctcttacgataataattagataaataacgtttataagaatctggtagtttatccatttggttaccgtgaactactataatcggcggattataaccacctgggtgagcatattttaatttaatgcgacgaccgccaatcatcggcggttggtgctcatccgttgccatttgcaaaatacgagttaaaagcgaagtcgtcattttttgagtggcacaagcataggcttctttaatcgaatcaaaaagattacctacaccacttccgtgcaaggctgaaataaaatgcacccgagcaaaatcaataaaatctaaacgacgatcaagctcagatttcacacgatctttcacatcttgatctaaaccatcccatttattcacgacgatcaccaaagaacgccctgcatttaaaataaagccgagcaaagataaatcctgatcagaaatattctctctcgcgtcaatagtcagcaatacaacattagcatcttgaatcgcttgcaaggttttaatcacagagaatttttccactgccaaatgcactttaccacgcttacgcacaccagccgtatcaatcaaggtatattgctgtccatcacgctccattggaatataaatactgtcacgtgtcgtacctggcatatcaaaaaccactacacgatcttcgcctaaaatacgattggttaaagtagatttacccacatttggacgacctacaatggctattttgatatttttatcttgttcttcttcaagttcttcgtctaacgcatcatcaattaatgccgtatcttcttctgaatcaaaatcgaattcttgttcccattcgtcttgttcttcctcagaagtgcggtcattttcatcggcgttttccattttttccgcaaaaggcgcaagtacttgttccattaattgagtaacaccacgaccttgtgaggctgcaatttgctcaatttctcctaaacctaactgataaaattcagcacaatgagaatccgcatcaataccatcggttttatttgccaccaccacagtaattttgttttgacgttggcgtaaataattagcaataccaatatcagctgccgttaaacctgctcgcgcatccacaaggaaaagaacaatgtcggcttcatcaatagcaagcaaagattgctccgccattttttcttctacgccctcttccgttccatcaataccgccagtatcaataacaataaaatcatagccagcaatatgtgcgtgaccatattttctatcacgagttaaacctggaaaatcagcgactaacgcatctctcgtacgagtaaggcgattaaataatgtggattttcccacattcgggcgaccaacaagggcgacgactggagttgccataaaaaatctcttattttgtcaaaaatggcggctattatatcggaagttaaaggattggtaaaaaatcatttcataaagaaaagaaaaagccacaggatacaatcctatggctttctaaatactgtttatttatctacaacttaacgttataataatctcgctttcaaggatccaacttgaaagcgagtgttgcgctttttcgcaacgtttgaagaggataagaaaatgattaagatcattatccttgttgtcgttttattattagcgagccagaccgcttactaataagacaacatactagggagtaaccgctccctagttcttcaaatattaaaagtttactttgtttttgtcaaggatgaataaatttcagatacaaaaaaagcacccttaggtgctatctttatttatcttaattggcggaatggacgggactcgaacccgcgaccccctgcgtgacaggcaggtattctaaccagctgaactaccactccgagataagatattaattttaaattggcggaatggacgggactcgaacccgcgaccccctgcgtgacaggcaggtattctaaccagctgaactaccactccgctaagtggtgcgtatcttaatgatgaacacaaatctcgtcaatctttttttattaaattttacttacctgattaaattccacacgattaatgcacattattattgccaaagcgtttttcccaaaggcaattatttccactttttttattcatcatctttaagaattctaaatgcgcttgtaactcatcattagtaggttgaagtaatttcaaattgtgcgaaaaatctaccgcactttttatttcttccgccgttttttcttgcataacatggataacttcagactcaacagattcttcatcgaataaatttgtttgccctcccgtcatcatcaaataaacatccgccaagatctcggcatccagtaacgcaccgtgcaaagtacgtttgctattatcaatacctaaacgctcacaaagtgcatccaaattattgcgttttccaagatacatctgacgcgccatttgtagcgtatctgtcaccaaacaaatatcgtcagttttcacattaaggttaagtttacgaaattcataatccataaatccaacgtcaaagggggcattgtgaataagcaattccgcaccattaatataatccaaaaaatcttgggctacgtctttgaattctggtttatccgctaacatttcatcagtaataccatgaactttaatcgcatcaggatcaacagggcgatctggcttaatataaatatggaaattattacctgtgtaacgacgatttattaattcaactgcaccaatttcaataatgcagtgtccttcataatgcgcgccaagctgattcatacctgtagtttcagtatctaatacaatttggcgattgggattaatcatttgttcaacctctctctttccattaaaatacttgccattctacacaacaacctttttgttatgcaaaaacagattgaaatttttactgatggatcttgcttaggtaatccaggggcgggtggaattggtgccgtattgcgttataaacaacatgaaaaaatgctctccaaaggctatttcaaaaccaccaataatcgaatggaattacgcgctgtcattgaagcattaaatacattaaaagaaccttgtttaatcacgctttatagtgatagccaatatatgaaaaatggcataacaaaatggatctttaactggaaaaaaaataattggaaagcaagttctggaaagcctgtaaaaaaccaagatttatggatagccttagatgaatccatccaacgtcataaaattaattggcaatgggtaaaaggtcatgcaggacacagagaaaatgaaatttgcgatgaattagcaaaaaaaggagcagaaaatccgacattggaagatatggggtacatagaagaataatacaactgatataacatcatatttttcgatacctaaaaatatttaatacttaaacctaaaaaagaacaaaaaacaatcaaattcatttaaaaaagtgtgatcttgatgagatttcaagaaaattaaaattttggagtattgacataaaaatttttttttgcgaagatgtggctcgtcgctcgcctattattttgtttggtgattagacaattctattggaaaaaagttcaatcatagatagtaacaaccataaggaatacaaattatgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactgttgcaggagaagtttatccacaaaaaatcagcaatggcgttcaggttggtgcaaaatatgatgcaaacaacattattgcaggtattgcttatggtcgtacaaattatagagaagatattgttgacccagatttaggtaaaaaacaacaagtaaacggtgcgctttcaactttaggctatcgttttagtgatttaggcttattagtgtctctagatagtggctatgcaaaaactaaaaactataaagataaacacgaaaaaagctatttcgtatctccaggtttccaatatgaattaatggaagatactaatgtctatggcaacttcaaatatgaacgcgattctgtagatcaaggtaaaaaaacacgtgaacaagcagtgttattcggtgtagatcataaacttcacaaacaagtattaacctatattgaaggtgcttacgctagaactagaacaactgagcaagctaaaggcgtaaaaactgaaaaagaaaaatcagtgggtgtaggtttacgcgtttacttctaatcatttgttagaaatacattattaaaagcaaggcgaatcgaaagattcgctttttttgcttaaaatcaagttaaaaaatgattaagttaaaagtgtataaatatttaggctattttataagtaacaaaatattaataaaaaatctgtgacatatatcacagatttttaaatcaattagctatttaagtatttactattaattctctttccactttccgtttactactgtgccgattacttggtaatttggcgtaaacactgctaagtttgctatcttacctttttctaccgaacctaaacgatcatctataccaattgctcgtgcaggataaaggttactcattctaatggcttcagcaagaggaatttcaacatattctaccgcatttttaatggattccatcattgtgattgatgcccctgcaatcgtgccattagcatcatagcaacgcccatctttgatataaattgtttttcccacaaaggtaaaattttctagttctggcggtgcgcctgccgctgcaatagagtcagtcacaatacaaagtttgtcgcctttgatttttttatcaatgcgaacattgccataattgatatgcacaccatccacgataatgccagtgtaaacatcagaatctaatactgcgcccactacgcccatttcacgtccagaactaattggcgacattgcattatgtaagtgggttgcaaatgttgcgcctttgtggaatgcggctttagccacttcataagtggcattagaatgacctacagagacaataatgcccgctttcacaaaatcaggcgtatagttaatggttgggttttctgcggcaatggttatttttgtaatcacatcgccattttcacagagaaaatctttcatttcaggcgtaatttcacgaatatattcggggcggtgtacgccttttttctcaatgctgagataaggcccttcaatatgtaaaccaagtgcttggtttttatgcttgtttaaatattcacgcataatttttaccgcactttttatattttcatcaggcgcggtaataaaagtgggaaggaaacttgtacaacctgattttaagttagtttcctgcataatttccaaggtttcaacgctagtttggtcgttaaacatcacgccaccacagccatttaattgcagatcaataaaaccagccgttaaattattaccttgtaaatcaatggttttgatacctgtttctaattcagcttgggggatcactgcttcaatagtttcgctatcaattactaccgcataatctcgtagaatttcgtatttagtgtagatcacactgttggttaatgcgtatttcatattctgttcctaatatcaacatcagtttaacatagcaactatattgctcttaaacgtaaggacaatttgccctatgattgtttgtgattatagggcgaatgtaattcgcccctacataaagatgaagaatagatctctatttatcctgataatccgtaccagcaaccgagccttctaattcagtaaaatatttcacggttttcacttttaactcttgttgagcagcttcatcacaaacaagcacgaaatgacggtgcatttgtaatgcactgactgtccataaatggttaatactgccttcaacggcagcttgcactgccagtgctttttgatgtcctgttgctaaaatcatcacttcttctgcatctaataatgtaccgacaccaatggttaaagcatatttcggcacttgagtaacatcgttattaaagaagcgtgaatttgcaattaatgtatcttgcgttagcgttttaatacgggtgcgagaacttaatgaagaagcaggttcattaaatgcgatatgtccatctacgccaaccccccccataaacagatgaattttgccgtaggatttaattttttcttcataacgatggcattctgcattatggtcatcggtattgccgttaagaatattgatattttcaggtaaaatatcgatatgattgaaaaaattgttatacataaagctgtggtaactttcagggtgttcctctggtaaagccacatattcatccatattgaaagtcactacgtgtttgaaactcactttgcctgcttgataaagtcgaatcagttcttgataagtttttagtggtgtaccaccagtaggtaaccccaatacaaaaggacgctcggcggtaggtttaaaatcgttgatacgattgatgatatgttgtgcagcccaacaactgacttgttgttctgtttgtaatggaataaaacgcatattagccttcctttattattgaccgtaatgatcctattcatatcgtaggctggactttagcccaccattcaccaaaggatcattataagtgcggtaattttctatcttgtttttaaaaagaaattcttttgctccaataatttacgacaaagcaatagaagttgcccccttccgcccttcgggcaccttcccccgtaaacaggggaaggaaagtgcttgctgacttgctgttctgtttgtaacggaataacagaggaaagcaagtgcttgctgacttgttgttctgtttgtaacggaataaacagaggaaggtaagttttttctaatttaaatatttatgacaaaaatttcgctttcaagtcttttgcttttgcaacctgttctgctgttgcttttgatgtcattggttcacggcaataacctgcatccaccccttctaatttaagcaattctttgatggttaaatataaaccgttcgctaaaatgccttcgattaaatcgttggttacgtgttggatttctaacgcttcggctaatttacccgctttggttaattcaaaaatttgacgagcacgaacgccgtttacgttgaaagttgaaccgattgcaccatccacaccaagtgaggctgccggtaacatcatttcatcaaaacctgcccaaattaagtggtttggataagcttttttcaaacgttctaataagtagaaatcacctgctgtgaattttacccctaatactttcgggtttttgtaaagttcaccgaattgttcaatgcccatattcacgccagttaagaacgggattgagtacacaatcatattgttgcccgtttcagcgatgatggtgtcgtaataatgtttaatttcagggaagctaaatttgtaatagaatggcgtcactgcagataagcagtcgtagcctaattctgttgcatatttacctaattccactgcttcttttaagtttacgctgcccacttgagcaattagtgcgatttgatcttttgcttcatcttttgcaatgcggaagatttcttttttctcttccgttgaaagcataaagttttcgcctgttgaaccgcccacatataagccatcaactttcattttgtcgatattatggcggataatttggcgtaaacctttttcattaatggtgccatcttcattaaatgacactaataatgcactgaaaataccttttaaatcacgcataagttttctcctattttatacgttgttcaagaattacattgagagttttttgtttagtttgagcggcaatttcttcttcgccctgcactaacaaagcataaattaaatctaatacaaaaagctgtgcaattttggtgccaatagaatcgccttgtaacttgccttgtttattaccatttaccaaaacataatcagcatattctgtcacgggggaacgcaaactatgcgtcaatgccactgttgttgcaccattttgttttgcgattttgatggtatgtgccgtttcagcagaataaccagaatggcttaaaccaattgccacatcagaagaggtcaataatgccgcctgcatatacataaaatgattattacctgaagcatccacttgaaaaccaatacgcatcagcttatttttagcatcttcagccgttacgccagatgaacccacaccaaataaaaaaatacggcgtgcttttttaagtactttaacgacttcttcaagctgttttaaatcaagtaaattaatcgtttcttccattacattagcaaccgccgtttgcaatttttgtgcaatagtgagcgaatcatcacttggcataatttctgtttcaagtatgctttcatcttgattatctttcgtcgcaagttcaatagaaagctctagtttgaactcgctgaaacctttaaaaccaatggttcgacaaaaacggacgagcgtagcttctccaacttgcaaatgtttagcgatttctgaaagggagcattgagagactaaatcaggcgaacgcaaaatcgtatcggcaatttttttctctgatttagttaaactctggtaaagtgagccaattttgtttaacacatttcccaatttagccataaattgttccttcaggcttatccagtaaaacatcttttacccaataagctgcgccaattaaacctgcatcttgtccaaatttagcggtttcaatttcacaacaatatatcgaaggaaaatcttgtaaatatttttcaaccaaagataaatatccctcagctaatcccacactgccaccaatcgcgattttttgaatatctaaactaatcactaaatcagcaattaaattagcaatggctttcgcagaacgctcgacaagtgcggtcgctttttcatcatttttctaaaacgctcaaacacttcttttggatcgcacggatcttcccattgggaagaaactgcttcaattgctcgccctgaagcaatcgcttcgacacaacctcgacgaccacaaccacagatcgcaccatttggatcagctaatgtatgaccaatatgccctgcaataccacgagaacctgtctgcaaaatttggttcagcacaatccctccgccaactcctgttgaaacggtaataaaaacaaaatttgatacctgttcaaaattttgcaattgatattccgcataagtcgcagcttgtgcatcatttaataaaccaatcggtttatccgtatgttttgcaatactcgctttaagtggaaattccgccaagccacctaagtttttcggatttaatgcacttaaaataccattattgataatccccgtagatgctaccgctacataatcaaactgcccttcataatcagcaagcaatttgcctaacgcttggtgcattccctccacgacattttcacgtggtgtatgaatttgctgacgttgctcaatttcgccattttttacaatcgccgctgcaatttttgtcccaccaatatctagtgctaaacaacgcataacttatccttatagtgtaaagtcttttctcacacgtcttacgactatcttgcagatttcactgaattagcaaaccaactcacaatatgttcaagacgagttaaggctgaacctacagtcacgcaatctgcaccaatttcaattgccacttttgccaattctggtgtgttataacgcccctcagccatcacaaaacaacccgctgattttaaatctttcactaattgataatctggttcttctggcactgcgccacctgtataacccgacatcgtactgccgacaatatcaaaaccaagcgctttacaatacaagccttcttctaaattagaacaatctgccattgccaaacagcccatttcgtggatttttttcaccgcactttcaatatccacaggacgtgggcggctcgtgccatctactgcaataatatccgcacctgcattggctagatcttcaatatcttgtaaaaacggcgtaatacgcacgggactatcaggcaaatcacgttttacaattccgataatcggaacattcacaaaaggacgggttgctttaaggttatcaacaccctcaatacgtaagccagaagcgccgcccataactgaagcctgagccatagcagaaacgatttcaggtttatccattgggccatcatcgacaggttggcaagaagaaatgagaccatattgaatttgagaaagtacgatgccngggttatacagggaacntnnnncacccctcatttaaatctgaataaatcactttaaaattaatttaatccacacaaaacaatcttttataagttgtaatatgcttatattttcatcatttaaccttattatatgaaaaagaaatgccattttaaagaatatttttgaagtgttttttcataaatgtgatcaacttctcatttttgaaataaaactcgtaaaactattttaaatttgtttttttactcttagaattgctctcgaatcctatttttggggagaaaacatacattttttgcctaaattgattctcatattacggggttaatatatgcccctttccaacataagttcacacaggagcgaatatgatgaaattgacaaaacttttccttgccacagccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgagcaatgttaaaacaattaaaagacggttctcttgacttcacctttgcagaatctgctcgcttccagttgttttaccctgaagcagcagtatttgccttaccttatgttattagcaactacaatgttgcacaaaaagccttattcgatacagaatttggtaaagatttaattaaaaaaatggacaaagatcttggtgttactttactttcccaagcttataacggtactcgccaaacgacttcaaaccgtgcaatcaacagtattgcagatatgaaaggcttaaaacttcgtgtaccaaatgctgcaacaaacttagcctatgctaaatatgttggtgcatcgccaacaccaatggcattttctgaagtttatcttgcattacaaacgaatgccgtcgatggtcaagaaaacccgttagcagcagtgcaagcacaaaaattctatgaagtgcaaaagttcttagcaatgactaaccacattttgaatgaccaactttatttagtaagcaacgagacttataaagaactccctgaagatcttcaaaaagtcgtaaaagatgctgccgaaaatgcagcaaaatatcacactaaattattcgtagatggggaaaaagatttagtcacattctttgaaaaacaaggtgtgaaaattacacatcctgatcttgtcccatttaaagcatcaatgaagccatattatgctgagtttgtaaaacaaacgggtcaaaaaggtgaagcagctttaaaacaaattgaagcaatcaatccataatccctctttagtgtgccgtaatggcacactacattcccttattcttcatcaagcggagtgaagtatgaaatatattaataagcttgaagaatggctgggtggcacattatttattgccattttcggtattcttatcgctcaaattctttcacgccaagtttttcattctccgttaatttggagcgaagaactcgccaagctcttatttgtttacgtgggtatgttaggtatcagcgttgctgtaagaaaacaagaacacgtatttattgattttttaactaatctgatgcccgaaaaaatcagaaaatttaccaatacttttgtacaattattagtctttgtatgtattttcttgtttattcatttcggtattcgtacttttaatgacgcatcattccctattgatgccttagggggcatttctgaaaaatggattttcgctgcactacctgttatcgcaatattaatgatgtttcgctttatccaagcgcaaaccataaactttaagacagggaaaagctatttacctgcgactttctttatcataagtgcggtcattttatttgcaattttatttttcgcgccagattggttcaaagtattgcgaattagcaattatataaagctcggttcaagttcagtctatattgccttactcgtttggctcatcattatgtttatcggtgtccctgtaggttggtccttatttattgctaccctactttatttttctatgacacgttggaacgtcgtaaatgccgcaactgaaaaattagtctatagcctagacagctttccattacttgccgtgccgttttatattttaacgggtattctaatgaatactggtgggattaccgaacgtatttttaatttcgctaaatccttactcggtcattacacaggaggaatgggacacgttaatatcggcgcaagtttattattttcaggtatgtcaggatccgcattagctgatgcaggcggtttaggtcagcttgagattaaagcaatgcgtgatgctggttatgacgatgatatttgcggaggaattactgctgcttcttgtattattgggccattagttccaccaagtattgcaatgattatttacggtgtcatcgccaatgaatctatcgcaaaactctttattgcaggttttattcccggtgtattaattactttagctttaatggcaatgaattatcgcattgcaaaaaaacgaggttatccacgtacaccaaaagccacaagagaacaactttgcagcagctttaaacaatctttttgggcaatcttaacgccattattaattatcggcggtattttttcaggcttattcagtccaacagaatctgccattgttgcagcagcatactctataattattggtaaatttgtgtataaagaattaaccttaaaaaccttatttaatagttgcatagaagcaatggcaattacaggcgtggtcgccttaatgattatgaccgtgactttctttggcgatatgattgcccgtgaacaagtcgcaatgcgtgttgctgatgtgtttgttgccgttgccgattcgcctttaaccgtattggtaatgatcaatgcactgttactttttcttggaatgttcattgatgccctagcattacaatttttagtattaccaatgcttattcctatcgcaatgcaattcaatattgacttaatcttctttggtgtaatgaccacattaaatatgatgattggtattcttaccccaccaatgggaatggctctctttgttgttgctcgtgtaggaaatatgtcagtttccacggtaaccaaaggcgtattaccgttcttgattcccgttttcgttacattagtattaatcacgattttcccacaaatcatcacatttgtgccaaatctattgataccataataaaaagtgcggttgaaaaacattaaattttttaaccgcacttttatctttctcgtaagttacatctgccgtaccttacaatacaaaaaggtgcaataactgcactttatcaacgcctattcaatgccgtttaatgaatagaaaactgtaaacacaactcaaaatggggtttattatgaaactaaccaaaacagcattatgcaccgcactttttgccacctttactttttcagcgaacgcacaaacttatcctgatttgccagtgggaatcaaaggaggaacaggtgcattaattggcgacaccgtttatgtgggattaggctctggtggcgataaattctataccttagacctaaaagatccttcagcacaatggaaagaaattgctacatttccgggtggcgaacgtaatcaacctgttgcagctgcggtagatggcaaactttatgtattcggtggtttacaaaaaaatgaaaaaggcgaacttcaactcgttaatgatgcttatcgctataacccaagcgataatacttggatgaaacttcctactcgttctcctcgcggtttagtaggatcaagtggtgcatctcacggagataaagtttatattttaggcggctctaacctctctatatttaatggcttcttccaagacaacgttgcagcaggagaagataaagggaaaaaagatgaaatcgttgcagcttacttcgatcaacgtccagaagattatttctttacaacagaattattgagctatgaaccctcaaccaacaaatggcgcaatgaaggtcgcattccattctctggtcgtgctggtgctgcctttacaattcaaggtaatgatctagtggttgtcaatggcgaaattaaacctggacttcgcaccgctgaaacccatcaaggtaaattcactgctaaaggtgtgcaatggaaaaacttacctgacttacctgcgccaaaaggcaaatcacaagatggtttagctggtgcacttgcaggctatagtaacggttattatttagtcactggtggcgcaaattttccaggttcaatcaaacaattcaaagaaggaaaacttcacgcacataaaggtttaagcaaagcttggcataacgaagtttatactttaaataatggtaaatggagcatcgttggggaattaccaatgaatattggctatggtttttctgtatcttacaataataaagttttactgattggcggcgaaactgatggaggtaaggctttaactagcgtcaaagcaatcagctatgatggtaaaaaattaaccgtcgaataatttatcacagaataatgcataaaatttataataatcaaaagcggcgaaatctatcgccgctttatacaaaataaaagtaattaaagcaaaattaacacaaattttgaccgcactttaaatgcgctataaagagctggcatttttattaataagatttagcgatgttatttattccaccaccactactctgtttattcattgccatagcaatgtattttttgccaaagattgctagttattctgtccatttttcagtgattgtttttgttatttccctttcatttttgattgctttaagcagcgttatgcaattctttatatgtaaaacctccattaatcctcgtgactttaaaggcacaacaaaattagtttccacaggcatatttcgatttagccgtaacccaatgtatttaagtttgctgttaattttgcttgcttggacgctttggttaggtaatagtttagcttggttaggcgtaattgtctttatactagttatgaaccactgtcaaatagcccgagaagaagcctatttggaaaataaatttggcgatgaatatcgtcgttacaaacaaaaagtaagacgttggctataaaaaacaccttcacgaggaaggtgtttttatcaaattaaactctattttttcggtgcctgcataaagcggaagaaatcactatctggttttaaaatcattatattgtcagaatttgcaaaactcgcttcataggcttttaagctacgcacaaaagtaaagaattgtggttcttgagcaaaagcatctgaatataattttgctgcagctgcatcgcctgaacctcgtaattcttgtgcagttttatttgcattagcaagaattaacgtcactttgcgatctacatcagcttgaataaatgctgctttttctttcccttgagaacgatgttcacgcgccactgcatcacgttctgcacgcatacgttggtaaatcgaagaagagacttcatctggtaaattaatttgttttacacgcacatcgatcacttcaatacctaattctgccgtactgtcttgtcctgaacttaaagctttttttgccccttccattaattctccacgtgtaccagaaacaatatctttaatcgtgcgtgaaccaatttcagaacgtaaacggtcgtttactttacgacttaataaatttgcagcttgagcataatcgccaccgccagtagatgtgtagaatcgaccaaaatcactgattttccatttcacataagaatccactagcaaatcttttttctcaacagtaacaaaacgtgttgcagagccatctaaagtacgaatacgcgcatctaaaactttgatgctatcaattaaaggcactttaaaatgcaagcctggttcatatacaaccactttgttatcagcatcacgctgtactttgttaaatcgtaacataatgccacgggtaccttccgttacaacgacgatactagaataaaccactgccgcaatcacgaaaataacaggtaataaaaatctacgcattagttaaatctcccttgacgaatcggcgcaacggtagtcggctgaggctgataagaattttgacgttctggtgcagtaaaagcaggcgaagaattgaccgcacttggcgcacttgttaccgattttttgcccataatttgctctagcggtaacacagttaaattattaccattattgccatcaagcattacttttggggtatttgccatcactttttccatcgtctgaatatataaacgctcacgcagtaaatctggtgcagccttaaattctggcaacaagcgttgcaaacgttccacttcaccttttgcatctaacacgatacgatctttataagctgttgcttcttcaagaatacgttgtgcatcaccgcgtgcaatcggttctttctcacgcgcataggcttccgcttcacgaataaaacgttgttcatcttcctgcgctttaattgcatcatcaaacgcatcttttacttcttcaggtggacgagcagattggaagttcacatcaataacctcaagtcccatatcataggatttgataatttcattcaaagctttccaagtattttcacgcacgacagagcgacctgtggttaaaatatcattcatagacatatgcccaataacataacgtaatgcactatctgtcgcttgattcaaactatcatctgcatttgttacgctaaaaagatattttgcaggatcttgcacgcgatattgcacggtcatttccacttttaccatattttcatcttgagtcagcattgcaccttgtgtacgcaactcttttacttgctccacatttactggcaatactttatctacaaatgttggtttccagttcaaaccgggttgaacaatagaatgtaactcgccaaaacgaagcaccacaccgcgttcagcctctttaatggtgtaaaaaccgcttacgccccaaataattgcaccaatcgctacagcaagtggaataactttgccaaaatgaaatggcgtattgccttgagaactgccattattttgaccgctctttttatttccaccacctaattttttaagcagattattaaaaatctcctcaatatctggcggagattgctcttgatttccacgattttgattgttattccatccattattattggatgaatttcccggctgttggtcgttgctttgccctggtttactccaaggatcgcgatctgaaccgttctgtgacatttcattctccatttgtcaaaaaattgttaagagtttagctaaataaatggggcacgtctatgaaaatataaggctttttaggcaataaaaaatccttgattttatataaggatttttttgattaattcacttcataaagaacatatttttcaagttcttttatctgtaaactttctctattccattcataaaagtgcggtaatttttcttgatgattgacaaaagcggctaaataaataggaagttcatcagtaaaccacaactgcccctgcggacaataatctgaaaaaattttttgttgttcaggaaaatgacgaacattggataattttacgatcccaaatccttgagatttcaataccgcctctcgcaaacaccaacaacgataaaaagcgttcaaagaatcctgctgatgatgaaaccaatcaatttcttcttttggtgcaatatgctccatcaacgctgtaaaatttcttattttaggaaattcaatatcaattcccaccgcacttttttcttcttttctaatatctaatattaccgccacccaatcaccagaatggctaatattaaaatctattcgctcatcaagaaaataaggtctgccactttcagtacgatgaatttgagataaaagtgcggtggattttcctgctatttttagaagttggaaaagtaataaatgcgcaagccgacgacactgatgacgctgaaaaacacgggagctatccgtttcaatttgatatagattttctggaatcagttcatcgggtaaggattccaaagaaaaaggttgatttatattgccgtaggcgatgtaggttgtcataaaataaaagcaccattcaaaggtgcttttatattaaaaggatttagtttgtgtgtaaattagcgaatcactaattccgccacagaaacaccgaccaagcaagcaacaacaaccccaattaaacctggcaccataaaactgtggttaaaataatatttaccaatttttgttgtacccgttacgtcaaagtttactgttgcaatatctgacggataatttggaatgaagaaataggcataagttgcagggcattaaaccaacttaagattggtgcaggaatacctaagccaatacccacaggtaataacattacggctgttgctgcttggctattaattacgacagaaactgcaaataatgccaatgcgaatgtccaagggtaagtttgcaccatatcagtaatcgcggctttaaattctggcattgcatatttgaagtaagtgtcgctcatccacgcaataccataaattgcaatcgctgctaccatacctgacttaaataccacaccattttgtacgatttgaggattcgttttcgttgcaagtaaaatcacaccaccaaaacaaagcatcatcatttgaatgataagtgacattgaaattgcttttccgctaccgatagggcgaatttcaggaatcatcgcaatcgcaacaatcacaactaaagcaagtaaaaataggtaaacagatttttttgccccttgcggaagggtttcattcaatgttgtactggtagtattaaaaatacgttcgcgccatactggatcttgaaaacgacgttgatattcaggatcttgttctaactctttaccacgacgcatactgtataaagaaagcgcaatcgtacccgctaaagtagcaggaacggttacacaaataatatctaataaactaatatgctcaaaagcgggcattgctgtaattttacctagataaaatacaacagctgcagaaagtgggcttgatgtgatggctaattgcgatgctaccgaagacgctgccattggacgttctggacgaattttgtttttcaatgcaacatcgccgatgattggcataattgtgtaaacagagtgaccagtaccaagcataaaggttaataaatagacgactaatgggccgagtaaagtgacacgttttggatttttacggagaatgcgttcagcaatttgtaacataaatttcaaaccgccagctgcttcaagtacggatgcgcaagtcaccaccgcaagaatgataagcataacatcaatcggtgctttccccactggcatacgaaatacgaaaacctcgatagcaagaccgataccagaaacaacacctaatccgataccgccgtaacggctaccgatataaagcattaatagtaaaaataaaaattctaagtaaagcataaacacctcaaaaatgaaaaactatgcaaataatacttctttttaggcatataactaaataattttttaaaatttaaaccaagattttaagtaaaagataatttagatcaatgtttatgaaagggaaaaataaaaagtgcggtaattttaaagaggattattagaaaaaaattaggcgacttaaaacgtcgcccaacttaaaattattgattgttttgcacgtaatcaatcgcagattgaacagtggtaattttttcagcttcttcatcaggaatttcaatatcaaattcttcttctaaagccattactaattcaactgtgtctaatgaatctgcacctaaatcttcaacaaaagaagcttcaggtttaacatcttcttctttaacacctaattgttcaacgatgatttttttcacgcgttcttcaatactcatttgtttttcctatttgttagttttaactcataaaagagctgttagtgtatgtattttttagtaacttgcaactattttatggtctggtcgcaccacaaaataggcaatgtgaacacacacatcaaatatagttacgtacctttgcatacgctcaaggcgtaaccaagttacattgcgagcgggattttagcattatctaaaatctttggctatgattttattgcttagaacccccccccccataaatcaatgtcaaagtttagcttaagtataagccaccattcacgtgtaacgttgtacccgtgatataacctgcatcatcagaagctaagaaagcaacggctttagctatgtcttttgcttcgcctaaacgtccagctggaacattagataagatccccgctttttgttcatccgtaagcacttctgtcatatctgttgcaataaaacctggtgcaaccacatttacagtaacaccacgtgcagctacttctttcgctaaagatttagaaaaaccaaccacacccgcttttgccgcacaatagttagtttgtcctggattacccgttgaaccaaccactgaaccaatattgatgatacgaccaaaacgttttttcatcattgaacgtaacatggctttagaaagatgatacacagaagttaagttagtttgcataatatcaaaccattcctcatctttcatacgcatcaataaattatcgcgagtaatacctgcgttattcacgagaatatcaatatcgccaaaatcatttttaatttgctcaagtaaagtttcgatagattctttatccgttacgtttaaaactaaacctttacctttatcccctaaataagccgagatcgcctctgcacccttttcagaggttgcggtaccaattacaaatgcaccttttgaactaagttcttctgcaatcgcacgaccgataccacggctagcccctgtcactaaagcaattttaccttgcattttttcttccttttacttacgctaaaaattcttctaccgcattgaatgatgcaacatcatttacagatattgcttgtaaatcacccacaatgcgtttggttaaaccatttaatactttacctggccccacttcaacaagcgctaaaacaccatcttgcgccattttttcaactgtttcagtccaacgaactggactatataactgacgaacaagtgcggtacgaatttcggtgccttcagtttcagctttcacatcaacgttatttaataccgatattgttggtgtattaatttgaatattctcaagtgttaccgctaattgctcggctgcaggtttcattaatgcacagtgagaaggtacgctcacagctaacggcaatgcacgtttcgcccctgcttctttacataatgcagccgcacgctcaactgcagctttcgcacccgcaataactacttgacccggtgagttaaagttcaccgcagatacgacttcgccttcctctgcttgtttgcaagcattaataattgcttcattatctaaaccaatgattgcatacattgcgccagtgccttcaggcacagcttgttgcattaattttccgcgcaattccactaatttaatcgcatcttggaaatccaacaccccagcacaaaccaaggcagaatactcacccaagctatggcctgccatcacttctggttttaattgaggaaatttttcttgccatacgcgataaatagcgactgaagcagctaaaagtgcgggctgagtttgccaagttttattaagttcttcagctggaccttgttgaacaagataccataaatcataaccaagcgcatcagatgcttgtttaaatgtttcaataacgattggatattcagtggcaagatcagcaagcataccgacagtttgggagccttgacctgggaagaccattgcgaattttttcattatgttttgtcctattgttttttaattgaaaattcttcttcggtaattaaaatcgggtttcgccgatggcgacttactttttctttgcttcgccaaagaaaaagtaagcaaaaagaagggaacccaatttgttctttatccgatttaaagtgcggtcaaaactcaaaatattttttgttcttaaaatgaatttaaaattaaccgcactttttaaataatgctctgataaattcggggccccatataaatcgcctttgcgactttcaatttttaggcaatttgcgtctgtttgagcgtagcgagttcagcaaattgccgttaagaaaattgaaacaaagcaaagaacagcgatttaactggggcgtgttttctttgcctactttcttttacacgagtaaaagaaagtaggtcgccgtcaggcgaacccctgacatttaacacaaaaagtgcggtcaatttttaccgcactttaaaatcatcaataattatatcaaatcaactaaaatctcactaacgctgaaccccaagtccaaccaccgccaaaggcttctaataatagtaactgcccacgttgaatacgaccatctcgaatagcctcatctaaagcgacaggaacagttgctgcactgttgttagcgtatttatctaacgttaccaccacttgcgacatatccatttctaattttttagctgttgctgtaataatacgtaaatttgcttggtgtggcacaagccagtctaaatcttttttatctaaattatttgctaaaagtgtttcttccaccacatttgaaagttcacgaactgccaatttgaacgtttcgttaccttgcatctcgatatagccagatttttctataccacgttctggctgagctaaaacaagggcattatttttatctgctgaagcgtgtaaatgggtggagataattccttcttgttcactcgcttctaaaattacagcacccgcaccatcaccaaatagcacaacagtgctgcgatctgtttcatctaatttacgagaattgagatccgagcctatcactaaggcttttttcactttgcctgcacgaataaattgatcagctacgctcaaagcatagacaaagcctgtgcaagctgccgccaaatcaaaagaaatcgcatcatcaatatttaataaaccttgcacttggcaagccgcacttggataagcatgtgagtgacttgtagttgcaacaataatcagttcaatatcttgaggattaatttgagcagcttcgatcgcattttttgccgcttcaaatcccattgttgcaacagtttcatcttccgctgcgatacgacgttcacggataccagaacgagtgacaatccattcatctgatgtatcaaccattttttctaaatccgcatttgtgcgaatatggctcggcagatagctaccggtggataaaattctactattcatactcaataagataagcgattaaaaaggaaaaaatctatggactatcgccaagtaagagataagaccacaccggattattttccgatgttaatggaatgcagatagtaatacggggaccaacgtccccgcccatcacatctaacaccaaggttagacggttcaagtgaacacctataagtaaaaaattacttattgatcactttacgaccacgataataaccgtctgcagttacgtggtggcgtaagtgagtttcaccgcttgctttatctactgatacagcagcagttgttaaagcatcgtgtgaacgacgcatatcacgacgtgaacgagattttttgttttgttgaacagccattggctatactcctaaatttaatttacttttgctttaaattagctaatacagcgaacgggttcggtttttttgccaattcttcaggcaattcgccaaaaacctgttcctgcgcggacacttcacagtgttcagatgaatgcattgggacaagcggcaaagctaaaattagctcatcttccaccgtgccaattaaatctatttcgccaaactcattgaactcgattggctcataaatttcgggcaagtcatcagcctgatcccaattagccactggactataagtaaactcacattccaatgtttgtttgtaaggttcgttacaacgctgacattcaagatcgacatcaatctgtactttacctttcatcaccactaatttttgtggatcaacataaaacgataatgttacctgtgcatcgctgagcacgtttaccactgattccgccaaacgctcaagctgatttgccgaataataaccaacataatcaagccgtctttgagcatcttttactggatcaacggttaggggtagttttaccttttgcatagggcgtgaatattacctgttgttgcgaagatagtcaaagggaaatcacattttttattggataactcaataaaggaaattatccgctaactaaaaaggttggaactataacaaaaattgctataatcacgcctctttttttaacaaggaaagataatgatgacttcaaattcttattggcaacgctttaaagtggcatttcaatatgtcatgccacaaatttatttaactcaaattgctggctggtttgctaaacaaaaatggggcaaaataacacattttgtaattaaagcttttgcgaaaaaatacaacattgatatgagcattgcgcaaaaaggacaattttctgattacgcaagttttaatgaattttttattcgtccgttaaaagaaaacgcacgtccaattaatcaaaatccaaccgcactttgtttaccagcagacgggcgcattagtgagtgcggtcatattgacgataatcttttattgcaagctaaggggcattttttcagtctagaagacttattggcagaagataaagaattagtggaaacctttaaaaatggtgaatttgtaactacttatctttctcctcgtgattatcaccgagtacatatgccgtgcgatgctacgctacgcaaaatgatttatgtgccgggtgatttattctctgtgaacccatttttagcccaatatgtacccaatttatttgcacgtaatgaacgtgtgatttgtgtatttgatactgaatttggcacaatggtacaaattttagtgggtgcaaccatcactgcaagtattggcacaacttgggcaggcgtaattaatccaccacgccacaacgaagtgaaaacttggacttatgaaggcgaaagtgcggtcaaattattgaaaggtcaagaaatgggttggttccaacttggttcaacagtaattaatttattccaagccaatcaagtgcgtttggctgatcatttaagcgtaaatgaacctgttcgcatgggcgaaatcttggcatataaaaaataaacaggatttatttccataaatgacagaaacaaatcctgaaagtagatatttctcacttctttaaaggcagtataaccttactgcctttttcttctttcatttgaacaattaacgcattgttacaaattcctctgaacctgttggatgaattgccaccgtattgtcaaaatcagcttttgttgcgcccattttgattgctactgcaaatccttgaatcatttcatctacaccgaaaccaataccatgtaaacccataactttttcatctttacccacacaaactaatttcattttgcacggttggcgatgttgagttaccgcagtgtacatcgctgtgaaagaagatttatatactttaacattttctgcgccgtactgctcaatcgcttgcggttcagttaaacctacagtgccgataggcggatggctaaatacaacggttggaactaaactgtaatctaaatattcagtcggtttattattaaataaacgctctgaaaggcggcgacctgctgcaactgcaactggtgttaattcaataccgttttcgataatatcgcctaccgcataaatgcctttcacattagtattttgatatttatctactttgacatagccgtgttcatttgtttctacacctgcattttctaagccaattttatctgtcgttggaacacgacctgccgcccaaataacgcaatctacggtaacatcagattgaccatcacattttacagtaagtgaaccatctgcattttttacaatttcagatggggtagaattggtatgtaattgaattccatcttgcgcaagcacttccactaatgtttctacgattaatggatcctgattacgcattggcgcatggcgacgcactaataaatgtgtttccacgcctaagctgtttaatacgccagaaagttcaacagcaatatagcctgcaccaataacaacagcacgttttggtaattcggttaatgcaaagaaaccatccgaatcaatgccgtattcttgtcctttaatatttggacgatatgggcggccaccagttgcgattaaaatatgatctgcggttacttgctcttttgtaccatcagcaagtgttacttcaatagtatgggcatcgacaaattttccgaaaccattaattacatcaatattatttttcgctaatacattattataagatgtatggatacgactaatataggcttggcgactttcaatcagttttgaaaaatcaaattttttcacttcaacatcaaaaccataatctggcgcataattgttgattgcttctgcaatatgcgcgccataaaacattacttttttaggtacgcaacctacatttacacaagtgcctccaagatgttttgcttcaatgattgcacatttttttccatagcttgctgctcgatttagagacgcaataccgccactgccaccgccaatagcaatataatcataatgtttagtcatagtttgatcctttttgaactcaaaaattttccgtattttgcctaatttttataaagaatgctataaattgatttaattggttttatgaatattttttattcttttgaacagatgattagtttgaaataattttatgtgaagcctagtatgtagaatgaaatagcgtgatagaaaaagaggaagattgttcaatcttcctcactgtagatatgtgattaattagaatattggttaatcgcagccgcaacttcttgatcttgataaatattgttcacaatatcattaaaagtttgagatagcactttatgaatttcatcattgtccgcattaaatacgccctcttgtgaacgcgtgacattaaatgatttattatacgaacctttcgcaccttgtacataaactgtcgcttgaattttagtattaagtttataacgaagattaccttgttctacttgcgtaccaaattcatgcacatctacagttacccacgcatttgaaccatttaattgcccaattctaaagcctttactaattaaattttgctgcatcacttgctgaaataattgtgtaacacttggggatgcatttaatttaatcagttccccgtgtttcgtataactcgcaatctcttgtattgtgcggctatcttttgttgtaacagatacaacggcagttcgattaacattcattgaagcacttggcacaggcggtgtaaatgctaatatatttgattgtgcttggcagcctgcaagaaataatgtagcagctagaatacctactgatgataatgttttaattttgtttactaatgccataatttccccataaatcaattagaattgtgctattcttacaaacttccttattaatgtatagcgtttcattttagtttttgtggagaacttatagtgtcaattcaacaaattattgagcaaaaaattcaaaaaaaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaactaagaattaaatcatagtattcacgcattagcattacatttattcactccagaagaatggaaagcacaaaatgaaactgtaccgcactcaacaaaatgtgcaggtattgggcgttaattttgttataaaaatgtaacatttttgatatatcgcaaaaagttctaacaaaaaaccctctgtttaagtagcgaaaaacagagattttcgctagaatgaggcgtttaatttagtccaaattcgatttctcggtaaaattattaactgtgaaatcaatccatttgagttttttattttgtgacattaatgtttttttagcggtttgtcacactcaaacgtgagattgcttctagggtatttttactatattagcaattgtatttttaaccttgaaaagtagtgcaaatagtatgattacaattaagaaaggtttggatctcccaatcgcgggaaaaccagcacaagtaatccatagcggcaacgctgtgaatcaagttgcgattctaggtgaggagtatgtggggatgcgtccttcaatgaaggtacgcgaaggcgatgttgtgaaaaaaggtcaagtactttttgaagacaaaaaaaatcctggtgtaatttttacagcccctgcaagcggtaccatcactgcaatcaatcgtggcgaaaaacgggtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttccatccattgaaagtgaagcatcttctatttttgtaaacgcgatggataccaatccattagcagccgatccctctgtcgtattaaaagaatattcgcaagacttcactaacggtttaaccgtattaagtcgtctattcccttcaaaaccattacacttatgtaaagcgggcgattctaatattcccactgctgatcttgaaaatttacagattcatgattttactggtgttcatccagctggtcttgtagggacgcatattcactttattgatcctgtcggtattcaaaaaactgtatggcatatcaattatcaagatgtgatcgctgtaggtaaattatttacaacaggcgaactttattcagaacgagtaatttctcttgcaggtcctcaagtgaaagaacctcgtttagtacgtacaataatcggtgctaatctttctcaattaacccaaaatgaattaagtgcgggtaaaaatcgtgtaatttctggctcagttctttgtggtcaaatagcaaaagattcacatgattatttaggtcgctatgctctgcaagtatcagtaatcgctgaaggtaatgaaaaagaattttttggttggattatgccacaagccaataaatattctgtgactcgtaccgtattaggccacttcagtaaaaaattgtttaattttactacttcagaaaatggtggcgaacgtgcaatggtgccaatcggtagctatgagcgcgtaatgccgttggacattttacctacattattattacgtgatttaatcgtgggcgatactgatggcgctcaagagttaggttgtctggaattagacgaagaagacttggcgttatgttctttcgtttgtccaggcaaatatgaatacggttcaatcttgcgtcaagtcttagataagattgagaaggaaggttaaaaatgggtttgaaaaatctttttgaaaaaatggaacccgcgtttttacccggtggtaaatacagcaagctttatccgatctttgaatcgatttataccttgctttatacacctggtacggtaacgcacaaaaacactcacgttcgtgatgcgttagattcaaaacgtatgatgattacggttttccttgcgttgttccctgcgattttctatgggatgtacaatgtgggtaaccaagcgattccagcgttaaatcaattaggcaatttagatcaactaattgctaacgattggcactatgctcttgcaagttcattaggtttagatttaactgccaatgcaacttggggctctaaaatggctcttggagcaattttctttttaccaatttacttagtggtatttaccgtttgtactatttgggaattgttattctctgtggttcgtggtcacgaagtaaatgaaggaatgttcgtttcaaccattttatttgccttgatcgttccaccaacattgccactatggcaagccgcattaggtattacttttggtatcattgttgcaaaagaaatttttggtggcgtaggtcgtaactttatgaaccctgcacttgctggtcgtgcgttcttattcttcgcatatccagctcaaatttcaggcgatacggtttggactgccgcagatggtttctctggtgcaaccgcactttcacagtggtcacaaggtggtcaaggtgcattgcaacataccgtaacaggcgctccaattacttggatggatgcttttgttggtaacttacctggttcaatgggggaagtttctacccttgcaattttaattggcggtgctgttattgtattcactcgcattgcagcttggcgcattattgctggtgtgatgattggcatgattgcaacctcaaccttgtttaacctaattggctcagagactaaccctatgttctcaatgccttggcattggcactttgttttaggtgggtttgcattgggtatggtatttatggcgaccgatcctgtttcagcatcttttactaatactggtaaatggtggtacggtgcattaattggcgtaatggctgtattaattcgtactgtaaacccagcctatccagaaggaatgatgttagcgattttatttgcaaacttatttgcaccgattttcgactacatcgttgttcaagcaaatatcaaacgtcggagagcaagaacaaatggctaagtttaataaagacagcgtaggcggcacaatccttgttgtgctactactgagtttagtttgttccattattgttgctggttccgcagtaatgttaaagcctgcacaagaagaacaaaaattgcttgataaacaaaaaaatattttaaatgtagctggtcttttacaagcaaatacgaatgtaaaagaaacttatgcaaaatttattgagccgcgtttcgttgatttagcaacgggtgaatacacacaacaagcagatgatagccaacaagcaattcctgctgatgcggataaagcacgtattcgttctcgtagcaaaacaactgaagtttatcttgtaaaagatgaacagggtcaaactcaacaagttattttaccaatttatggcactggcttgtggtcagtgatgtatggcttagtatctgttcaaccagatggtaatactattaatggaatcacttactatcaacacggagaaacaccgggattgggcggagaaattgaaaatccaaactgggcaagtctatttaaaggtaaaaaattatttgatgagcaacatcaacctgccattcgtattgtaaaaggtcaagctccacaagatgaacatagcattgatggtttatctggtgcaactttaacaggtaatggtgttcaaggtacctttaattattggttcagcaaagatggctttggtccatatcttgaaaaacttcattcaggagcaaactaatgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgcttcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcgatgttaattatcgtagcatttttccgtgaacttatcggttcaggtaaattatttggtatgactattttcgaaactattcaaaatggtggctggtatcaagcaaatggtttattcctacttgcaccaagtgcattctttatcatcggatttgtgatctggggattaagaacttggaaaccagaacaacaggagaagtaatcaatggaacattatattagcctatttgttaaggcagtcttcattgaaaatatggcactttctttcttcttaggaatgtgtactttcttagcggtatctaaaaaggtgtccactgcgtttggtcttgggattgcggtaactttcgttcttggtatcgcagtgccagtaaaccaattaatttatgcaaatgtactaaaagaaaatgctttaattgaaggtgtagatttatcattcttaaacttcatcactttcattggggttattgctggtttagtgcaaattcttgaaatggtgttagataaatttatgccatctctttataacgcattagggattttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataaggagtgtaatcaatgagcgattcagtaattcttgcactcggtattgccgcattcacggttattgtattagtgttagtggcaatcatcttatttgcgaaatcaaaattagtcgattctggtgatattactatcgacatcaatgacgatcctgaaaaagcgatcacattacctgcaggtggcaaattattaggggctttagcaagtaaaggtattttcgtgtcttctgcttgcggtggcggtggctcttgtggtcaatgtattgttaaagtgaaaaatggcggtggagaaattcttccaaccgaactttctcacattaacaaacgtgaagcaaaagaaggttatcgtctagcttgtcaagttaatgtaaaaggtaatatggaagttgaacttccagaagaaatcttcggcgtgaaaaaatgggaatgtactgttatttctaacgataacaaagcaacttttattaaagaacttaaattagcgatccctgaaggcgaggaagtgcctttccgcgcaggtggttatatccaaatcgaagctgagccacatgtggtgaactataaagatttcgatattcctgaagaataccacgaagactgggataaatacgatttatggcgttatgtctctaaagtggacgagcatattatccgtgcttactcaatggcttcataccctgaagagaaaggtatcattatgcttaacgttcgtattgcgactccaccaccacgccaacctgatgcgcctccaggtcaaatgtcttcttacatttggtcattaaaagcaggagataaagtcacaatttctggtccatttggtgaattcttcgcgaaagaaactaatgcagaaatggtatttatcggtggtggtgcgggtatggctccaatgcgttcacatatcttcgaccaattaaaacgtttacattctaaacgtaaaatgtcgttctggtatggtgcacgttctaaacgtgaaatattctatcaagaagactttgaccaattacaagctgaaaatccaaactttgtatggcacgtggcactttcagatgcattgcctgaagataattggactggctatacaggctttattcacaatgtactttatgaaaactacttgaaaaatcatgaagcaccagaagactgtgaatactatatgtgtgggcctccagtgatgaatgcagctgtaattaaaatgttgaaagatcttggtgttgaagatgaaaacattttattagatgactttggtggctgattttagttaatcaattcatcataaaagctgaccgcactttgtgataaagtgcggtcaaaatttaagatgtttttaaaaattttctatgattacaggtaagttttgttgagtttgccagtaattcacaaatttaggaaatccagatgaaaaaattaataagcggtatcatagcggtagcaatggcattaagtcttgctgcttgtcaaaaagaaacaaaagttatctctttaagcggtaaaacaatggggacaacttatcatgttaaataccttgatgatggttcaataaaagcaacatctgaaaagacgcatgaagaaattgaagcaatcttaaaagatgtgaatgcgaaaatgtccacttacaaaaaagattcggaattgagccgcttcaatcaaaatacccaagtgaacacaccgattgagatttcagcagattttgccaaagtattagctgaagcgattcgtttaaataaagtgaccgaaggcgcgttggatgtaactgttggtccagttgtaaatttatggggatttggtcctgaaaaacgccccgaaaaacaacctacaccagaacaattagctgaacgccaagcctgggttggcattgataaaattgcccttgatatgagtggtgcaaaaccgacattaagcaaagcacttcctcaagtttacgtagatttatcgtcaattgctaaaggttttggcgttgatcaggtggctgaaaagttagaacaactaaatgctcagaattacatggttgaaatcggcggtgaaattcgtgcgaaaggaaaaaatattgaaggtaaaccttggcagattgccattgaaaaaccaactacaacaggcgaaagagcggctgaagctgtcattggattaaacaatatgggaatggcaagttctggcgattaccgtatttactttgaagaaaatggcaaacgctttgctcatgaaattgatccgaaaacaggttatccaattcagcatcatttagcctcaattacggtacttgcaccaacctcaatgactgcagatggcttatctacagggttatttgtgctgggggaagacaaggcgttagaagtggctgagaaaaataatcttgccgtttatttaatcattagaacagataatggttttgttaccaaatcatcctctgctttcaaaaaattaacagaaacaaaagaatagttatgcaaactttattttttactttaatcgctttcgtcgcaattatattgttgatgtctatcggctttattatcaaaaaacaaagtttaaaaggcagctgcggtggtttatctagccttggtattgacaaagcttgtgattgtgataaaccttgcgacacgcttcaatcaaaattagatgcaggcgatgaacaagcaaaagctgaatatgagcaaaaatttgcgaaaaaagatgataactcgcaattttatgaagtgaaataacttgctcaaaactgaccgcactttatgtgcaaaataaaattaacggcaaaattattttgccgttttctaattcaatgaccaatgtgcttcgccttaaccgaagttacgggagaactatgttaatttcaaatacttataatcaacactttcctcaactgacgcaagaacagcttgcgagaaatgcgacaaaaaaagtgatttgtggtatgtctggtggcgtggattcttctgtgtcagcttttattcttcaacagcaaggctatcaagtggaaggcctgtttatgaaaaactgggaagaagatgacgatactgattattgtactgccgcagctgatcttgcagatgctcaagcagtatgcgataaattagggatcaaactacataaaattaattttgcggcagaatattgggataatgtctttgagcattttttaactgaatataaagcaggacgcacgccgaacccagatattctatgtaataaagaaattaaatttaaagcatttttagaatatgcagctgaagatctcggtgcagattatattgcaacagggcattatgtacgtagagcgggagataatgaaaatgcaaaactattacgtggtttagatgccaataaagatcaaagttattttctttatactttaagccataaacaagtggggcaaagtttattccccgttggtgaaatcgagaagcccattgttcgcgctattgctgaagatcttggcttaattacggcgaagaaaaaagattctaccggtatttgttttattggtgagcgtaaatttaaggatttcttagcacgctatttaccagctcaaccaggtaatattcgcactgtagatgatgaaattattggtcgtcatgatggattaatgtatcacacattgggacaacgcaaaggattgggcattggtggtctaaaaaatgcgggagatgaagcttggtatgtagtagataaagatgtagaaaataatgaacttattgtcgcgcaaggtcacgatcatcctcgtttattttcaaaaggattgattgctagccaattacattgggttgatcgcgaaccaattcgagagtcattacgttgcacggtgaaaacacgttatcgccaacaagatattccttgtgtgattgaaccaattgatgatgaaactattcgagtgatttttgatgaacctcaatcagcagtaaccccagggcaatctgccgtattttaccttggcgaagtttgtttgggtggcggtattatcgcagaaagaatataaaacaaagatgactaaaagcgcgtaaaatgcgcttttaaactatttattcaaaccaaatgacactcgccattcgtcccgtttgattgtccctgcgataagaaaagaacttttctttttcgttgaatgtacagtgatttccaccataaatttgcgtaatacctagattgtttaatcgctgagttgcaatttgataaagattactcaagtatttaccttcttcgattgcatcaggttgaaaggcgagtttggctttttcatctactgcaacaaacttttctacaacatcaatcccaacttgaaaggcctttggacctattgcagggccaaaccacgcaataatatcttcaggtttagcttgaaaatatttcactgtttcttctagtacgccatcgcataaaccacgccagccagcatgtgttgcagccacttcattgccagatgttgtagtgaatagaactggcaaacagtctgcagtcataacaacgcaaacttgattgggaacatttgtataaactgcatccgcttcaagattttgtcctgaataaggtaattgaagtactcgagtgctgtgtgtttgcgttaaaaatataggtttttgtggcaagccaaatttttcgactaataaagtgcggttagtttttaccgcacttttatcatcaccgacatgatcgcctaagttgaaactcaaataaggcgctaagctcacgcccccttcacgagtagtggtaaaggcatgaatattctttggaacattccaatttgggttaattgcttgcatattaataatctaactcatcttgatgtttgagatagtcggctttgagtgcattaagcaattcaacaaagtcatctggtaatggtgcataccattccataatttcccctgtgattggatgagctaagcgtaacatgaccgcatgtaaagcttggcgtttgaaattacgcaatacttccataaagtcttcactcgcatttttgggtggacgagggcgtccgccataggtttgatcgcctagcaatggatgggcaatatgtgccatatgaacgcggatttgatgcgtgcgccccgtttctaaacgtaaacgtaaacgggtgtagttacggtaattttccataatacgataatgagtaacagctggttttcccattggatgaacagccattaaagtacgtttggttgcatgacgagccataggttgatctactgtgccgcctttagtcataatgcctgaagcgactgcttcatattcgcgcgtaattttgcgtttttgtaagtctcgcactaacttagtttgtgctggaatggttttagcaacaaccattagacctgttgtatctttatctaatcgatgcacaattcctgctctcggtacttctgatatcggtggataatgatagagtaacgcattgagtacagttccatttggattgccagcaccggggtgtaccacaagatcttttggtttgttaatcacaataatatcatcatcttcatacacaatattcaatggaatattttctgcttcaaaacgtgtttcatcttccacttcaacaataatctctattctctctcctccaaacactttctcacgcggaatattagtaatgcggtcgttaagttttacgagatcggcttcaatccatgtttttaatcgggaacgagaatattcagggaacaactctgcaagtgtttggtctaaacgttgtcccatttgttctggctgcacttcagccgaaagggtaatttgtggcataaatagctctcaaaaattttaaaagttggcttattgattaatgttctatacaatagcggacaattgtatcttatttattggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaactcaagattatacgcaagtattattgatggtagatagctttttacatcaatttccacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttatgctcaagatgctttagcgcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatagcaataactgcagaaaaatcgaatactctctgcacctaaaagttgaataaaatttaaactaattaaggtgcagatttttttattttttatcaactgaaaatgcttcaccatagttcgcacaaataatctgagcagcattataaagcgttgtatcaggtgttaaacttaacgtatgtttcttttgctttttaggtgctgcccgcaaaccctgtccccaaaattcatcatagaaatcagttcgtacttgagttaaatgataatttgcacaattcaagatcttatactgacgaacagaacgtgcataacgtttaggctcaggataaacatacaatcccttatctaaattcaccactgcatcaaaatgtacaatttgtggctcttggttatccacccagatcgattcactatcgatgtaataattcacattctttaccaaacgtatatatccgcttcgtacatcagtcggcggtgccagcttcacatcattttgtttagccttttggatttgagcagaacaggcagtaagtaacccaagtgataatgttaaaataatttttttcattatttactccttatgttagctgacatttattctagaattttacagtgtgcccataaccttctaggattgttttaatatgctctaaggattctttagttggcggtaatacatcttcaagctcataatctaacccaagggttttccatttatgtgcacctaatcgatgataaggaagaagctcaactttttcaatattggtcataccttcaataaactgacctaataaatgcacatcgtgatcgctatcagtataaccaggaaccacaacataacgaatccaggtatgttgattacgtttttgcaaatattttgcaaattcaagggtacgtttattgggtaccccaataagattttgatgaacttgatcattaagctcttttaaatcgagtaaaacaagatctgttacatctaataattcatcaataatatgattataatgacgtacaaaaccatttgtatccaagcaagtattaatcccttccgctttacaagctcggaaccaatcgcgtacaaactctgcttgtaacacagcctcgccaccagatgccgtaacaccaccgccagtagcattcataaaatggcgataagtcacgacttctttcattaaatcttcgacactgatttctttccccccttcaagatcccaagtatcacgattgtggcaatatttgcagcgcatcaagcagccttgcataaataaaataaaacgaatacctggcccatctacagtgccacaggattcaaaagagtgaattcgtccaagaactgacatacataaatttcctaaaattagatatagctaaattttaccaaatatttagtctataaaaaatgagcctgatttaaatcaggctcattatgttcccaccaaagtgcggtcaaaaataaaaatgtttttacattgactctgtgaaagttctagtaattacgtcttgttgttgctctttagttaaagagttaaaacgtactgcgtaaccagatacacggatagtcaattgtggatatttatccggattttccattgcatctaacaacatttcacggtttaacacgttcacatttaagtgttggccaccttcaaccgttgcttcgtggtggaagtaaccatccattaagccagcaaggttgcgacgttgtgcttcggcatctttacctaacgcatttggtacgattgagaaggtataagaaataccatctttcgcgtaagcaaatggaagtttagctacagaagttaatgatgctaccgcacctttttggtcacgtccgtgcattgggttcgcacctggtccgaatggtgcaccagcacgacggccatctggggtgttgcccgttttcttaccataaactacgttagaagtaatggttaatacagattgtgtaggcactgcattgcggtaagttttaagtttttgaattttcttcatgaaacgttcaactaagtcacaagcgatgtcatcaacacggttatcgttattaccatattgtggatattcaccttcaatttcaaagtcgattgctacgttagttgcaacaacattgccatctttatctttgatgtcgccacgaactggtttaacttttgcatatttgattgctgaaagtgagtcagccgcaacagaaagacctgcgataccacaagccatggtacggtatacatcacgatcatgtaatgccattaatgcggcttcgtatgaatatttatcgtgcatatagtggattacgtttaaggcagtcacatattgtttagccaaccaatccataaagctatccatacgagtcattactgtatcgaaatctaatacttcatcagtaattggtgcagttttcgggcctacttgcatacctaatttttcatcaataccgccgttgattgcgtataacaatgttttcgctaagtttgcacgtgcaccgaagaattgcatttgtttacccacaatcattggtgatacacaacatgcgattgcgtagtcatcattgttgaagtctggacgcattaaatcatcgttttcgtattgaactgatgaggtatcaatcgatacttttgcacagaaacgtttgaagttttcaggtaattgttcagaccaaagaatggttaagtttggctctggggaagtacccatgttgtaaagggtgtgtaaaatacggaatgtatttttggttactaatgtacgaccatctaaacccatacctgcgatggtttcagttgcccacattgggtcgcctgagaataattgatcgtattcaggtgtacgtaagaaacgaaccatacgaagtttcataactaagtggtcaactaattcttgcgcttcagtttcagtaatttttcctgcttttaaatcacgctcaatgtacacgtcaataaaggttgcggtacgaccgaatgacattgcagcaccattttgtgattttattgcagcaagataagcaaagtacatccattgaatggcttcttgagcattagttgctgggttagaaatatcataaccatagcttgctgccatttgttttaattgacctaatgcacggtgttgttctgcgatttcttcacgtaaacgaattgttgcttcaagatttacgccatcttctaaatctttttgtaaagaagagaattgtgcatatttatctttcattaagaaatctacaccataaagtgctacacgacggtagtcaccgatgatacgaccacgaccataagcatctggaagaccagttaataccccagatttacggcaacgtaaaatatctggcgtgtaaacatcgaatacaccttggttatgtgttttacggtattcagtgaagatttttttcacttttggatcaagttcacgaccataaactttacaagaaccttccaccattttgataccaccgaatggcataatggcacgttttaaaggttcatcagtttgaagaccaacgattttttctaaatctttgttaatgtaaccgggtgcgtgagagataatggtagatggtgtatgttcatcaaaatctaatggcgcgtgagtacggttttcaattttaattccttccattacagattcccaaagcttggttgttgcttcggttggacctgctaagaaagagtcatcgccttcataaggggtatagtttttttggataaagtcacgtacattgacattttcttgccaatcgccaccagcaaaaccagcccacgccaatttttgcatttcattaagttctgacatagtcatttcctttgttaattaataaataagtaaatctttaatgcgttttggttaaataacgttggaatacaccaatacaaattgccccgccgacaatatttcccaacgttacagggattaaattcttcacgatgaaatggtacaaatctaaatctgcgtatttcatcggatcaacgccgatttgttgccaaaattcaggtgtactaaaatgtgcggtaataattcccatcggaatcataaacatattagccacacagtgttcaaatcctgatgcaacaaacaaaccaatcggcataatcataataaatgctttgtctgtaacagtcttaccagaataagacatccaaaccgccacacacaccataatgttacataaaatacctaggttaaaagcttcaaaccaagtgtgatgaattttatgttgggcggttgcaagaattgttaaaccccattgaccatttgctgccattgtttgtccactaaaccaaataacagccgcaataaataaaccaccaacgaagttgcccaaatatactacgatccaatttcgaatcatttgtgtcgtggtgattctaccgcctacacgggcgactaaagttaaagtagaagaagtgaataattcagatcctaaaatcaccaccataattacgcccaaggagaatactaacccacctactaacttggttaatccccaaggtgcgcctgcactagcagtttgtgttgtcgtgtaaaatacaaaggctaaggcaatacaagcaccagcactaataccagacataaacgataaaaatggacgtttatttgctttataagttgctgtattttctgcataatccgttgcttcaacaggtgtgagcgcaacagaagatagtttttgattttctgatgccataatcaaactccaactattgacattgaaaaaattgatgaaaatttaatacttttaacaagtttacgactacaaatacttctataattggtgctattttactctcctcccctttcattgcaaagaaaagcaaaaattatttcaacaaactttgatattttgcaaggtttgtttaattaaagacaaaattcccatattaatattcgctcaatttcatacattcagagtaagtaaagcacttaatttgaaacttgttttattcgcgtaataccgtgaattcccccagataatcatccacttttccaaaaccttgattattcacaacaggcaaattcataattttttcaaacgaaccagattaagtgtatagacttgctattttgagtaattaatagcattattttgatctttttgaagaaaaaggcgatctttgtcataaaataatgatttaagtgcggttaaaattttggttaattttaagtgcacttctttatacaggagcagattatgtattatggtttagatattggtggcacgaaaatagagcttgccgtattcaatgaagaattagaaaaattatattctgaacgggtgccaacacctaaaaccgactatgaagaatggcttaacacgattgtggatttagtgaatcgtgctgatgaaaagtttggtgaagtgggcaccgtaggtttgggcgtacctggttttgttaatcaacaaactggattagccgaaattaccaatattcgtgtggcagataataaaccgattttacgcgatttgtctgtgcgtttaggccgtgaagtgcgggcagaaaatgatgcaaattgttttgcattatctgaagcgtgggatacggaaaatcagcaatatccgactgtacttggtttaattcttggaactggttttggtggcggctttgtcttaaatggtaaagttcattcaggtcaagtgggaatggcgggagagcttggtcatttacaactaaattatcatgccttgaaattattgggatgggataacgcccctatttatcaatgtggttgtggcaacaaggcttgtttggataattatttgtctggtcgcggttttgaaatgctttatcgagatttgaaaggcgaaacattatctgctcgtgaaattattgatttgttctatcaaggcaatgaaagtgcggtagattttgtgaatctttttgttgagttggcggcgatttctattggcaatatcattacggcatttgatcctcatatgattgtactcggcggtggattatctaattttgattacctttatgaggctttaccaaaagcattaccgcctcacttgatgcggacagcaaaagttccaccaattaaaaaagcgaaacacggcgattctggtggtgtgcgtggcgcggcagcgttgtttttaaccaaataattcaacaaactagtggggcgtattcaaataatatgccctttgtttttgaaaaatatttagaatattctaaatttattagattttttcttttttgtttttcttttctttagagaaattattaaaaaatctcgccttttcattgaaaaaccatacaatcaaattatttatcgcttgagggatgattatggactttgaattttcaaaaatgttagaagaagtgctaacttggatagtcgcacaccttgacgggcctttatgggatgtcacaattattattttgcttgggactggtctattttttaccattacaacaggatttgtgcagttccgtttattcccagcaagtcttcgtgaaatgtggtttggtcgtgcggtggagggtagttcgttaacacctttccaagcatttacgacaggtcttgcgagccgcgttggtgtgggtaacattggtggggttgcaacggcaatcgccttgggaggcgaaggcgcagtgttttggatgtgggtaacggcatttattggtatgtcgagtgctttcgctgaatctacccttgctcaattatttaaaattcaagataaagatggatcattccgcggtggccctgcttattatattgttcaaggtttaaaatcacgttgtatggcagtggcttttgcacttgcattaatttttacatttggttttgcctttaattctgtgcaggcaaactctattgttgaagcaacgagtaatgcgtggaattggaaaggggaatatgtcggtatttcattagtaatttttaccgcacttattattttcggtggcgttaagcgtattgcgattatttcgagcaaccttgtaccaatgatggcacttttctatttgattatagcagtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcggggatgggatctgcgcctaattcggctgcagcagctcacgttaagcatccagttagccaaggtttagtgcaaatgctcggtgtgtttgttgatacaatgatcgtttgtacttgtactgccgttattattttgctttcgaataattatggtagcgaaacgctcaaaagtatctcacttacgcaaaatgctttgcaataccacataggtgaatttggggtgcatttcctggcgtttatcttattgttattcgcttattcttctattattggtaactatgcttatgcggaaagcaatatccgttttataaaaaataaaccttggtttgtatttttgttccgtttaatggtgctatttttcgtgtatttcggtgcggttcgctctggcaatgtggtgtggaatttcgcagatacggtgatggctgtcatggcaatcattaacttgatcgcaattttgatgttgtcgccaatcgtatggaaattaatgaaggattatcaacgccagcttaaagaaggaaaaacgccagagtttaaaattgatgaataccctgaattacgtaagaaaatatttgattcccgcatttggaaataaagataaaatggctagaaagagattatctacctttccaaagagttagattattatttaaagaaattttttgatattgtttcaggcttggttcttctagttcagactgaataaactattgccggcactttttaccgccctcgtgccggctatcccaaactgctttgaaaactgaccgctctttagcttacttcaaaaattccgcatgataggcaatatgctcgccaataaaactggcgatgaagtaatagctgtgatcatagcctttatggaagcgcacatcgacaggctgacttgccactcgacaggtttcgataaaatcttcggtacgcaattgtgtaggcaaaaactcatcttccaagccctgctcaatgcgcataccttgcactttatagccttgttgaatgagcgagctggcatcatattgctgccatttttcacgatcttcccctaaataggtagaaaaggctttttctccccaaggcacctggcttggcgataaaataggcgaaaaggcagaaacactttgataacgttcccgatttcgcagtgccaataccaatgcaccgtgtccgcccattgaatgtcccataatggaacgtttgccgttagtagggaaatttgcttcaatcaaatcaggcaattcattcaagatataatcatacatttgataattcgtcgcccaaggctgctcggtcgcattaagataaaagcccgctccctgccctaaatcgtaagccgcatcattcggcacttgctctccgcgagggctagtatcgggggcaaccacaatcacttgatgttctgcggcataacgttgaaagcctgatttggtaatgaaattttgttctgtacaagttaagccagaaagccaataaatcacgccaagcggtcgattttctggattatttggcaaatagacggcaaatttcatttcgcattgcaacatttgggcattatgcgcccaaacttgctgtgaaccgccaaaaatttgatgttgttcaatcagtttcataacgtaccttagtaatgaataactgtgcggatcgatttaccttcgtgcattaactcaaaggcttcattaatttgatcaagtggcattgtgtgagtcacaaacggttctaactggatgtcgcctttcattgaatcttccaccatttgcggaagttcagagcgacctttcacgccaccaaatgccgagcctttccaaacacggcctgttaccaattggaacggacgcgttgaaatttcttgtcctgcacccgctacgccgatgataatggattgtccccagccacggtgagcactttctaatgcttgacgcattacgtttacattaccgatacattcaaaggtatggtcaatgccccatttattaatatctaacaacacatctttgatcggcttatcgtaatcattagggtttaaacaatccgttgcaccaaactgttttgccaactcaaattttgcaggattggtatcaatggcgataatacggccggctttggcttgacgtgcaccttgcactaccgctaaaccaatcgcacccaagccaaacacggcaacagagtcgccttcttgcacttttgccgtattatgtaccgcaccaatacctgtggtaacgccacagccaagtaaacatacttgttcgtggttggcttctgggttgattttcgccagtgaaacttctgcaacaactgagtattcactgaaagtcgaacagcccatatagtgatagatcggctgaccttgataagaaaaacgtgtcgtgcaatcaggcattaagcctttaccttgcgtgtcacgcactgagacgcataggttggttttaccctagcgacaaaactcacattcgccacattcagcagtataaagaggaatgacgtgatcgcccggttttacgcttaacacaccttcgccaaccgcaacaaccacacccgcaccttcgtgtcctagcaccacagggaataccccttcaggatcgcttcctgataacgtaaacgcatcagtatggcaaacgcccgtgtgcgtgttacgaattaacacttcgcctttgcgaggcatttctacgtcgatttccacaatttgtaagggttgatttggggcgaatgctaccgccgcacgagatttgatggttgagttgatttgtttaatttccattgtttttcctcttaatccattgacaaagttgccttacgtaagcaagatagcaacagtttacactttagagttcactctaaagcaagtgtttttttaccatttttgtttaaagggaataaaaagtgacttacaccaccgctaaagctgctgaaaaaataggcatttccgcctacaccttacgcttttatgacaaagaaggcttgttacctaatgtcggacgtgatgaatacggtaatcgccgttttaccgacaaggatttgcaatggttgagtttattacaatgcttgaaaaatacaggaatgagcttaaaagacatcaaacgctttgcagaatgtaccatcattggcgacgatactattgaagaacgcctttccttatttgaaaatcaaacaaaaaatgtaaagtgtcaaattgccgaattaaaacgttatttagatttgcttgaatacaaattagcgttttaccaaaaagcgaaagcactaggctcggtaaaagctgtgaatttaccgcaaattcctgaaacgagctaaaaggataaaagtgctcacatcacagaattagaagaaaaatacaatttttagagatagataaattttaacttttttattacatcaataagttaaaaatcaggttttgtgatcaagatcaggataacataaaaataatctcctatagctattgttctaaatggctaaaaagagtatattccgagccaaattttttcttttttacagaacggagtttattatgtttggtttatcccccgctcaactgattattttattagtcgttattttattgatttttggcacgaaaaaattaagaaatgctggctcagatcttggtgcagcagtgaaaggtttcaaaaaggcgatgaaagaagatgaaaaagtaaaagatgcggaatttaagtctatagataatgaaacagcgtctgcaaaaaaagaaaatataaaagagaaagagcaggcttaatccgtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaaatgcggctgaaaatgcagaaaaacctcaaaatgcaatctcagttgaggaggctgcagaaactttatctgaagcagaaaaaacacctacagatttgaccgcacttgaaactcacgagaaagtagaactgaacacacatttatctagctattatcctcctgatgatattgaaatcgctccagcgtcaaaatctcaatcttcaaaaactaaatcatagcgagtttttatgagtaatgtggatgaatctcaacctttaattacgcaccttgttgaactaagaaaccgtttattacgctgtgtgatttgtgtagtgttggtttttgttgctttggtgtatttttccaatgatatttatcattttgttgctgcacctttaacggctgttatgccaaaaggcgcaacaatgattgcaaccaatattcaaactcctttctttacgccaattaaattaactgcgattgttgcaatttttatttctgtcccttatttgctttatcaaatttgggcttttattgcacctgctttatatcagcacgaaaaacggatgatttatccgttgttattttccagtacgattttattttattgcggtgttgcttttgcttactatgtcgtctttcctcttgtattcagcttctttacacaaacagccccagaaggcgttaccatcgcaacagatattagtagttatttagattttgctttagcgttatttttagcttttggcgtttgttttgaagtgccaattgcgattattctactttgctggactggtattaccactgtaaaggctctttccgaaaaacgcccttatattattgttgcagcattttttattggaatgcttttaacgcctcctgatgttttttcacaaactttgcttgccataccgatgtgcttgctgtttgagctcggtctattggtcgctcgattttatcaaccaaaagacgacgaaagtgcggttaaaaataatgatgaatcagaaaaaacacaatgatgaacttaattgttaatagtatgggagctttgcccccgtttttattatattgatataaccctaattttgttttttcataaaacatattttcgtagtgatttactagaaatatgatttgtagtctgctctatatttttattgaaaatatcattacctgatggttttctgtcgttttttattttttatctaataaatacgatattttttagataatttctttactttttccttttctttaaatttcctttataaaaatggttgcaagattaaattagccattgcatattgtctatgcgcttcacgaggcgtatacaataaaaaatacaatacacacaacatcaacaaagagggaaattcattatgtcaaaagttgcttccttagacgcatttttaacaaaagttgctcaacgcgatggttatcaacctgaatttttacaagcggttcgcgaggtattcacatcaatttggccttttttagaagccaatcctaaatatcgttcagaagcattattagaacgtttagttgagcctgaacgtgcatttcaattccgtgtggcgtggactgacgataaagggcaagtgcaagtaaacagagcatttcgtgtacaatttaatagtgccataggcccatttaaagggggaatgcgtttccatccatcagtaaatttatctatcttaaaattcttaggttttgagcaaatctttaaaaatgctttaacaacattgcctatgggcggagcaaaaggcggttcagattttgatcctaaaggcaaatctgatgctgaagttatgcgtttttgccaagcattaatggctgaactttatcgtcacgtaggagctgatacagatgttcccgcaggcgatataggtgttggtgggcgcgaagttggctatttagctggctatatgaaaaaattatcaaaccaatcagcctgtgttttcactggtcgcggtctttctttcggtggtagtttaattcgtccggaagcaacgggatatggattaatttattttgctcaagcaatgcttgctgaaaaaggcgatagttttgcaggtaaagtagtttcagtttctggttctggtaatgtagcacaatatgctattgaaaaagcattatctcttggtgcaaaagtagtaacttgttctgattcatcaggttatgtttatgatccaaatggatttactactgaaaaattagccgcacttttagaaattaaaaatgtaaaacgtggtcgtgtgaaagattatgcagaactgtttggtttgcaatattttgaaggtaaacgcccttgggaagtgcaagttgatattgcgcttccttgtgcaactcaaaatgaattagaactttctgatgcacaacgtttaattaaaaatggtgtgaaattagtggctgaaggtgcgaatatgccaacaacaattgaagcaacagaagcattattagctgcagatgtattatttggcccgggtaaagctgccaacgctggtggtgttgctacttctggtttagaaatggcacaaagttcacaacgtttatattggacagcagaagaagtggacgctcaattacatcgcattatgttagatattcacgcaaactgtaaaaaatacggcacaattgaaggtcaagaaaacattaactatgttgttggggcaaatgtagcaggctttgttaaggtggctgatgcaatgttagcccaaggcgtttattaacaaataaaaaagttaaactaaataaccgcactgtaataaagtgcggttattttttaggatgaaatttgaatataagaaaggcgacattttgtcgccttagatattatttattttgaattgttttcgtcacaatgattaatatcactgcatttgccgtaaagatacacgttatgcgtttttaattttatgccgtatttttcactgatttcacgctgacgttgttcaataatattatccgtaaattcaaatactttaccgcaatcttcacaaataatatgatcgtgatgttctgttggagcaagctcaaaaacggatttatttccctcaaaattatgacggattacaatatgtgcttcatcaaattgattaagcacacgataaactgtggctaatccaatttcacaaccttgttccagcaaaattttataaacatcttctgcagaaaaatgttcatttttatgattttgcattaaagcgagaatagttaagcgaggctctgtaatttttaatcccacttttttgagtaatttaatattttcttcagacataatttttcttcctattatgcacaacatactaagccaattcagctaagcacatttcatcataaatttgtttacaccatttttctacacgctctgcggtaagctctggttggcgatcttcatcaatacataatccgatgaaagtgccatcttccaataaggctttcgaagcttcaaaattatagccttctgttggccaatttcctaccacaattgcaccgtgtggctctataatatcgcgcacagttccgatagcatcacagaaataatctgcataatcttcttgatcgccacaaccgaaaatacctacaagtttatctgtaaaatcgatttcttcgagtgttgggaaaaagtcatcccagtctgcttgtgcttcgccgtaataccaagttggaataccgaaaagcaagaaatcgtatgcttcaatatcttctttgctacttttggcaatatcacgaatatcaattaaatcactacctaattgtttttggatttgttttgcgatgttttcagtgtttccagtatcactaccataaaaaagaccaactattgccatttttatttccttttttatattaaatttaatctatcgattataaggcttatccaaatttggcgaactatatcataaaagcattctcacttaaactacttaattcttatttagaaatcgtttaattgcacgaataacaaaatcaggtttttcggcgtgaacccagtgtccactgccattaatcgtaaaggcagttgcattaggaaattgttctagaattttttcgctattttctatttttatataagaggaatttccacccttaataaaaagagttggcgtaaatacacgtactttttcccaatccataatattggcataattgttaaaaagtgcggtaagattaaaacgaaaacaatcagctgaattaacatcaaaagatttcaacataaattgtacaacgtcttcatcattaatttcttgttttaaaatcggtttggcttgctgacgattttcaggctttgcattttttaccgcaataggccattaaaaacatctttatgaccaaatccctcataaagcataggggacatatcaattacgattaattnttcgactaattctgggcaaagtgcggtgattttcatgggcggttttcccccccatagaatgaccaattaatatcactttggataaatttaagtggcggattactgcgataacatcttcagccatcagttgataattcattttttccgaatgaaaactatggccgtgattgcgtaaatcaatacgtaaaatactgtaatgttcactaaaagctctcgcgataacgccgagattatccatatcgccgaataaaccgtgaataaaaattaaaacaggtgtattaatcgtttgttttacttgatgaaattgataattgagtaatgattttgccataatttttacgtgagaatttgtaaagaagtcgttataattgaaaaaaattttagcaaacagagagataaaaatgaagatcattgaagtagatgaagaattataccaatatattgcgagccaaacccgctctattggggaaagtgcttcggatattttacgccgtttgcttagtttacctgtgcatacttcaagtgttgatgatttagttcttacttcagcagaaactaacaaatccgcagatcaaaagccagaacaggctattaatgtgaaagaagtaaatatcaaaacaacaaaaaagcaatcaataaccgcaattaatcagatagtagaaaaagtccaaactttattaaattcaactgaatttcaagaagaaagtaaggcggtggtgcgtttcttagcgattttacgtgtgctttatcgtacaaatcctgaaagttttgcgcaagcaacggaatctttacaaggacgtactcgagtttactttgcacgtgacgaagcgacattattaatggctggcaatcatacaaaaccaaaacaaattccagatacgccttattgggttattaccaatacaaatagtggacgaaaaatgttgatgctagaaggtgcaatgcaatctatggaattacctgaaacattgattgatgaagtgcgatcatatttcacggtaaattaataatgtatccttggcaaaattttgctattcaacctgatttctcagataaaatcgctttacgtactacgcagagcgatgcgcttacttggatagaattaactacaaagattaaccaaacggtggcttttttacaaaaaaaaggcgtaaatgcggaaagtgcggttgcttttgtgggaaaaaattcagagaaaattttatttttatatctggcgacaattcagcttggcgcaaaagttttaggcatcaatcctgcttttccacaagaaaaaattgcagaattatgtgagttttatcaaattgatttttgtttttatgataaagatttgctgaatttgcaagaaattgatgcttttacacaaaaagctaatttttttcgtcctgcgacgatgacgctaacctctggttctacaggcttaccaaaagcagttgtgcataatgtccaagcgcatttggataatgcaaaaggggtatgtaacttaatgaagtttgattgtaatcaatcttggttactttcattacccttatatcacgtttcaggacaaggtattgtttggcgttggttatattgtggtgcacaattacatttcccaaaagatgatttttatgcttcattattagaaacgacccacgtttctcttgtgccaacgcaattacaacgtttgttagattatttacaggaaaattcgattatttcattttctacacgtcatattttacttggtggtacgcatattcctgctgaactcacgaaaaaaatagtgaaatatggtattgaaacttattctggctacggaatgacggaaatggcttcgacagtttttgccaaaaaatctgatgaaaaacaaggtgtggggcaaccgctcttaggcagagaatatcgcttagtaaatgatgaagtttggctgaaaggtgcgggtttggcgatgggttattggaaggatcgacaaattgtttcattaacgaataaccaaggttggcttccgacaaaagataaaggtgtttggcaagagggcgaacttgttattatcggacgacttgataatatgtttatttctggtggcgaaaatattcagccagaagaaattgaacaagtgattattcaacattcttcagttaatcaagtgtttgttttaccacaaaaaaacaaagaatttggtcagcgtcctgtcgctttagtggattttaatgaatcctttagcaaaagtgcggttgaaaatttaatgttttttttacaagataaactcgcacgttttaaacaacctattgcatattatcctttaccactgatgcttgggaaaggcattaagatctcacgtaaacagcttgccgattggctggcaaagcaagataagataaattaattttaccatttagattaggaaaaaataatgattaggaaacttatgaaaacacctccattttttaccgtactttttgcctcggcaatgtttacccttagtgtttcacaaggggcattaggggcaaattcaacaaatgtattaccaacggagcaatcgcttaaagccgatttggctaacgctcaaaaaatgagtgagggggaagcaaaaaatacgttgttagcagaattacaaacatcaattgatttattgcagcaaattcaagctcaacaaaaaatcaatgatgcattgcaaacaacattaagccattcagagagtgaaattagaaagaataatgcagaaattcaagcattaaaaaaacaacaagaaacagcaacaagtactgattataatgcacagtcacaggacgatttacaaaatagtctcgctaagttaaatgatcaattacaagatacgcaaaacgcattaggcgcggcaaatgcacaattggcagggcaaaattctatttctgaacgagctcaagcggcattaacggaaaatgttgtacgcactcagcaaattaatcaacaattggccaataatgatattggtagcgcattacgaaaacaatatcagattgaattacaactgattgatttaaagaatagttataatcaaaatttattaaaaaataatgatcagctttctttactttatcaaagtcgttacgacctattgaatttacgtttgcaggtgcaacaacaaaatattattgcgattcaagaagtcattaatcaaaaaaatcttcagcaatcacaaaatcaactagaacaagctcagcagcaacagcaaaaaactgtgcaaaatgattacattcaaaaagaacttgatcgcaatgcacagcttggtcagtatctattacaacaaacagaaaaagcgaattcattaactcaagatgagttaagaatgcggaatattttagatagcctcactcaaactcaacatactattgatgaacaaattagtgcattacaaggcacgttagttctttcacgtattatccagcaacaaaaacaaaaattaccgactaacttaaatattcaaggtttatcaaaacaaattgccgatttgcgtgtgcatatttttgacattactcaaaaacgcaatgaactttatgatctaaataactatattaataaagttgaaagtgaagatggaaaacaatttactgaggcagaaagaacgcaggttaaaacgctattaactgagcgtcgaaaaatgacatctgatctgattaaatctttaaataatcaattaaatctcgcgatttctttggaattaacgcagcagcaaattacacaaatcagtgatcaaattcaatctaaattagagcagcaaagtttttgggtgaaaagtaataatcccattaatttagattggataaaaatgctgccaagagctttaattgaacagtttaatggtatgttgaaaaaattaggttttccaactaattatgacaatttaccttatttacttatgtatttcttagggttatttattgtaggtggtgcaatttttaaatttaaaaatcgtattaaacaacaattaaacaaaattaatcgtgaaatacatcgcttagatacagatagtcagtggagtactccacttgccctgttattaactgcgtttttaacgctttctagtacactttggtttttagccgtttgccaaatgatcggcttctttttcttcaaaaatccagaagaattttggcattggtcatttagtatggcaggttattggtggttctttacattttggatttcattgttccgtccaaatggtatttttgttaatcattttgaatcttcaaaagagaatgcacaacgttttcgtggtgttatccaacgcattattattgtgattgtattgcttttaaatacttctgtgtttagcaatgtcactgatgcaggtttagctaatgatgtgttaggtcaaattaatactattacagctctaattttctgtgcggcgattattgctcctcgctttaatcgagtacttcgctcttatgaacctgaaacaaataaacatcattggttaataagaattgtacaaattggtttaagattaattcctgtgggactaatcgtacttattgttttaggctattattacactgctttaaatttaattgagcattttattcattcttatattgcttggtgtgtatggtggttagtacgtaatacgatttaccgtggtattacggtttcttctcgtcgtttagcacatcgccgtttagcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaataaggggaaattatggcaggtaatacaattggacaactttttcgtgtgacgacctttggggagtcacatgggattgcattaggctgtatcgttgatggggtaccgccaaatcttgaattatctgagcaagatattcagccagatttagatcgtcgtaaacctgggacatcacgatataccacgccgcgtcgtgaagacgatgaagttcaaattttatctggtgtgtttgaaggaaaaactacaggcacaagtattgggatgatcattaaaaatgctgatcagcgttctcaagattatggcgagattaaagatcgttttcgccctggtcatgcagactttacctatcagcaaaaatatggcatccgtgattaccgtggcggtgggcgttcttcagcgcgtgaaacagcgatgcgagttgcagcgggagcgattgcaaaaaaatatttacgcgaacattttggtattgaagtccgtggttttttaagtcaaatcggtcatgtgaaaatttcgccacagatcatcggagaaattgattgggaaaaggtaaacagcaatccattcttttgccctgatgaaagtgcggtagaaaaattcgatgaattgatccgtgaacttaaaaaagaaggagattctattggtgcaaaacttactgttattgcagaaaatgtacctgtaggattgggcgagccagtatttgaccgtttagatgcagatcttgctcacgcattaatgggaattaatgcagtaaaaggcgtcgaaattggtgatggttttgcagtggttgaacaacgtggttcggaacatcgtgatgaaatgacacctaatggctttgaaagtaatcacgcaggcggcattttaggcggaattagttcaggacagccaattatcgccacgattgcgttaaaaccaacttcaagtattacaatttctggtcgttcaattaatcttaatggcgagccagtagaagttgtgacaaaaggtcgtcacgatccttgtgtgggtattcgtgctgtacccatcgcagaagccatgatggcgattgtcttattagatcatctattacgttttaaggcgcagtgtaaataatcttagtataagatgggagtctgtgcctagggtaggtataccctaggttagtttgatgttacccctttgggataagtggaaagttccccaaaggggaactattttttctaaccgtgggtatacttacccacggcaaaacctaagatatgcttacccatagcaaaactttagaatgaataaaattttattaaaaacaaccataatttttaccgcacttttctctctgaacgttgttgcgtctcctctagattggcaaaaagtgaaacgtcctattccaagtgacgatgggaaagcaaaacctattggtagctataccaatgggtgtattattggggcgcaagcactaccgccgaaaggagacggttaccaagttattcgtatgaatcgcaatcgttattatggtcatccaaatatgattcagtatattgaacgtttggggcagcgagctaaagctgctgggttaccaactatgttagtgggtgatattgccatgccgggtggcgggcggtttttaacgggtcatgctagccatcagatgggattagatgcggatatttggttaagaatgggcgaaatgtcagacgccgatgcgctgaattctgatggtaaaggtttattagttgtagatagaaaggcgcaacgagtggatgaacgagtatggaatagcaatcatgcgacgttaatcaagttagccgcacaagatccaaatgtgacgcgtatttttgttaatcctgcgattaaggtaaaattatgtcaaaccgctggcaatgatcgcggttggctacacaaagttcgtccttggtatggacacaactctcattttcatgttcgtttaacttgccccgcagatgcatcttattgtgaaaatcaagcgcctgtgcctgctggtgatggttgtggagacgaattatattcttggtttgaaccgccaaaaccaggtgcttcagtgagcaaacctaaagttacaccgcctgagccgtttttgtgccaacaaattttaaattccccgaatcggagtgaatggttagaatagcattaaggtaaatcaatatggatatcggcattgatcttttagcaatattgttttgtgttggttttgtcgcatcatttatcgatgcaattgctggcggtggtggattaattactattccagcgttgcttatgactggcatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttcagccctaggtacattattaattcaatcaattgacgtggcgattttcaaaaaaatgctgccttttttgattttagctattggtctatattttttatttacccctaaattaggtgatgaagatcgaaaacagcgtttaagttacatgttatttggtcttttagttagcccatttttaggtttttatgatggcttctttggaccagggactggctcaatcatgagtttagcctgtgttactttgctaggatttaatctcccgaaagcgacggcacatgcaaaagtgatgaacttcacttcgaaccttgcttcttttgcgcttttcttattgggtggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatgatttacgatcagggttggtttcatttttaattcggaaagcgcgcaaaagtgcggttaaaattaattacattttattatgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgattaaaaatagggtttgaaagtcatattctcgaaaacggatattcaataaggtaaataagaaatggaagaaaaaattcggctgacgcaatacagccatggtgcaggttgaggctgtaaaatttcgcctaaggtgttagggacaattttacattcagaactggaaaaattttatgatccaaatttgctcgttggcaatgaaactgcagacgatgcggcggtgtatgatcttggtaatggaactgcaattatcagtaccacagacttttttatgccgattgtagatgatccttttgattttggacgaattgccgcgaccaatgccattagtgacatttttgctatgggcggtaagccgattatgggaatcgctattttaggttttccaaccaatgtattacctgcagaagttgcacagaaaattgttgatggtggtcgttttgcttgccatcaagcgggtattgctttggcgggtggacattccattgattcgcctgaacctatttttggtttagccgtgacaggtgtgattgacactgaaaaagtaaaacgtaatgcttctgcaaaatcaggttgtaagctttatatgacaaaaccgcttggtattggtattttgacgacggcggagaaaaaaggaaaacttaagccagaacatcaaggtttagccactgccgctatgtgccaaatgaattctattggcagtcaattttcccaagtggatggcgtcacagcaatgacggatgtcactggatttggtttacttggccatttaattgaaatctgtgaaggttcaaatctaagtgcggtagttttttcggacaaaattaaaaccttggacggagtaaaagattatattgctcaaggttgcgtacccggtggaacagggcgtaattttgaaagttatggacataaagttggcgcattaacggaagaacaaaaagcgattttgtgcgatcctcaaacatcaggtggtttattagtggctgttgagcctaatagcgttcaaactataattgaaatagccaaagatactggcattgatttatatgaagtgggtaaattgaaacctaaatcagaatccgatatcgttgttgaagtaaaataaggaattttaatcgatcatcctaatgattaattaaattaccatgatccacatagcaaaaaaccttggaatatcccaaggttttttagattatcattaaatataatggaattatgcgcctaaacgctctttaatacgagctgatttacctgaacgttcacgtaagtagtaaagtttagctttacgtaccgcacctttacgtttaactgcgatagaatctacagctggagagtgagtttggaatacacgctcaacgcctacgccgttagatactttacgcaaagtaaatgctgagtgcaagccacggttacgaattgcaataaccacgccttcgaatgcttgcaaacgacgtttgctaccttcaactacccatactttaacttctaaagtatcacctgggcggaagctaggtacgttttgttttaattgttcttgttcaagttgtttgataatgttagacattgtttgatcctttattgatcctagatgtaactgaaactaactgttatgctcggcttgcgcctcttttaacagcttacgttgttcgtcagtcagagctaggccttctaagagctcagggcgtcggaaccacgttctctgtagcgattgttttaatcgccatttccgaatttcttcgtgatgtcccgacatcagcacgggtggtacagttaatccttctaacacttccggtctggtgtaatgcgggcaatctaataaaccatctgcaaaagaatcttcttctgcggaggcttgtttgcctaatacaccaggaataaaacgtgcaacagcatcaattaatgtcattgccggcaattccccaccagttagaacgtaatcgccgattgaccattcttcatcaatttcagtttgaatcaaccgttcatcaatcccttcgtaacgtccacatactaaaatcaatttctgattttgagcaagctcggttacgccgtcttgatcaagtttacgtccttgtggcgaaaggtaaatcacctttgcgccttctcctgccgctgcttttgcagtatgaatcgcatcccgtaaaggttgcaccatcatcagcattcctgggccaccaccataagggcgatcgtccacagttttatgcttgtcgaatgtaaaatttcttggattccaacattcaactttcagaagattatgttttacggctctacctgtaaccccaaattccgtaatcgctttaaacatttcggggaataatgaaattacccctatccacataaaaagcctactacattacgtttgtgcatacttgagattagaaaccagcgtcccaatccacttcaattgtttttgtggtgagatcgactcttttaactacttgttcatacaaaaacggaattaaccgctcttgttttccaaaagcatctttggtattggctttaaccactaatacatcattagaacccgtttccatcatttctgttactgttcccattgtataaccttctaagtttacgactgtacaaccgattaaatcgtgccagtaataatcgccctcttctagttctgggaaaacagataaatctacaccaatttcaacattcgctaaaatttgtgcagtttcacggtcatcaacgccttttaatttaacgatgatttcgtgattatgataacgccagttttctaattcaattgattgccattcacctttgatttttaaaaaccaaggttgataatcaaaaatgctttcagcttgttctgttgatgaataaatacgcaaccacccacgaataccgtaggttgagcctaatttgcccacaacttcaatatgttgttgttccatatttttcacctatcttagtttgagaactaaatcaaaaagcaaaattatgctgctttttgtgcttcttttaccaagctcgcaacacgatcagaaagtgaagcaccttgagcaacccagtgatttacacgctcaagattaatgcgaagacgttctgcattaccttgtgcaattggattgaagaaacctacacgttcaatgaagcgaccgtcacgaggtgaacgactgtcagcgactacgatttgataaaatgggcgttttttagctccgccacgagataaacgaatggttaccataaccttcctctaaatgtttaattactaaaagaatattctcaaattcgaaagtgatttgagaatatagcttacttttttctctgtatatatagacaaaaagcctgcgaattttatacttttcaagcaaaattgcaagttttgtatgcataaagtaggttgtattccttttaattatcattcacaatttattttgttttgcgatataatacgaggcatccagctgttttaggtcaaatttacgcgtatagcggtattttagcttgataaaatatcagttaaatgaggtttattatgaaaattagttttcattctgtgttaattggattagcatcatttattggtgttcaacaaggtgtaatagctagtccatcttctcatcaatcaatatccactgaatcagctgaggctttgaagcaacaattttcaatggctttagctaaacaagacaaacaacaaattacaaatttacaaaaaaaacttaccgcacttttttctttacctccccaatttcttgataatcagatccaaataagcgaaaaaatcctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcgtatttagatcaacctcgagaaaatttacagcacaataatgatgcaattcgttacaaaacctttcaagcaatgctagaaggtttaaattaatcccttaccaataggagtttttatgcttttatccaaaaaatcagctacctttgcactcagtgcatttgcgatgcttttcactagtgtagctcttgccaaagaggcaccacaagctcacaaagctgtggaattaagtattttgcacatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattggtactgcatgcaggcgatgccattactggtacgctttacttcacgctgtttggtggttctgcagatgcagctgtgatgaacgcaggtaattttcattattttactttaggtaatcatgaatttgacgcaggtaatgaagggttattaaaactgcttgaaccattaaaaatccctgtgctttcagctaatgtgattcctgataaaagttcaattttgtataacaaatggaaaccttacgatattttcactgtggatggagaaaaaattgccattatcggtttagataccgtgaataaaacagtgaattcctcttctccgggtaaggatgtgaagttttatgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagagcctgtatttgtaatggaaggctgggcttattctgccgtggtgggggatttaggtgttaaattcagtcctgaaggtatagcgtctattactcgtaaaattcctcacgtgttaatgagttctcataaacttcaagtgaaaaattcggaaggtaaatgggctgaattaactggcgatgaacgtaaaaaagcacttgatactttaaaatcaatgaaaagtatttcacttgatgatcacgatgcaaaaaccgataagcttattgctaaatataaaagtgaaaaagatcgcttagcacaagaaattgtgggcgttatcactggttctgcaatgccaggtggttcagcaaaccgtatcccaaataaagcaggatctaatccagaaggttctattgcaacgcgttttattgcagaaacaatgtataacgaactcaaaacagtggatttaactattcaaaatgctggcggtgtacgcgcagatattttaccgggcaatgtaacctttaacgatgcttatactttcttacctttcgggaatacgttatatacctataaaatggaaggttcgttagtgaaacaagtgcttgaagatgcgatgcaatttgctttggttgatggctctacaggcgcattcccttatggtgcaggtattcgttatgaagcgaatgaaacaccaaatgcggaaggtaaacgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttgcctgatgcagaaagtttcataaaatttatgaaaaaacatccgcactttgaggcttacacttcatcaaatgtgaaatttaatgcttcaactgatgcattacctaaaaaataaaattgaaaaataggctaaaaatagcgcgtatttaacgcgctatttttgttattagtcctaggtttgaagacttcatagatgattaagaattttaactattccatatttagatgctttctcgtggaaaataaattccctataaaggttgaaaaatagggtgatttattgcgataatctaccccattttttgggagatctttctatcttctgcatttttacgcagtttattttcattagaaatgatcgaattttatttcacttttaatttaattagataaaaaacaatggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactggtgggggagcagtgctttctaaggaaaaccgtaattatttatcagcacgtggtattgtaatttatttagaaacaacggtggaaaaacaattccaacgcactcaacgtgataaaaaacgtccattgctccaagatgcagagaatcctcgtcaagtattggaagatttagcaaaaattcgcaatccgctttatgaagaaattgcggacatcactttgccaactgatgaacaaaatgccaaagtaatggtaaatcaaattgttgatttaattgataatatgaatggattaaatggtgcgctttaaacacacctaaggataaattatgttgtgcgtcaatgtggaattgcaagagcgtcgctatcctattttaattggtagcggattgttacaagatgaacgtagttacccgattaaacgtggggatcgcgtgatgattgtaacgaatcccacggttgcacagttttatcttgatacagtcatctatgcgttggaaaaacgtggttgcgtagtcgatcatgttttattgccagatggcgaaaaatacaaaacacttgaatctttaaacttaattttcaccgcacttttgcaagataatcatgggcgagataccacgattattgcattgggcggcggcgtaattggcgatgttgctggctttgtggcggcaagttatcagcgcggtgtgcgtttaattcaaatgccaaccacattgctttcacaagtggattcttcagtgggcggtaaaacggcggttaatcatgaattaggcaaaaatatgattggcgcgttctatcagccatcaatggttattattgatacgctcacgcttaatacgcttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgttgcgagagatgaaacagaaaaaggcgatcgtgcattgcttaatcttggacatacttttggacatgccattgaaactcacttaggttatggaaactggcttcatggtgaagctgtttcgacgggaatgatgatggcagcggtgctttcggaagaacttggagatatttctattgcagatgtgtctcgccttgaaaaattacttgctcgtgccaatttgcccaccgtatcaccggatacgatgcagccagaagactatttaccgcatatgatgcgtgataaaaaagttctatcgggtaaattgcgtctggtgttactcaaatctctaggccaagcttatgtggcgaatgataccgatcataccctcgtgttaaacgcaattcgtcgttgtactcaaacggattaagatgttacgtccgaaaaaacaatctttaaaacctaagttaaaacaccgtccatttttaaaatgggcggggggaaaatttcgtttaacggacgagataaataaagcctttccaaacaaaaaaaactgcttaattgagccatttgtgggtgctggagcgatatttctgaattctaattttgaacgctatattttggcagatatcaaccctgatttaatcaatctattcaatattgttaaagaaaatgtagagggttatattgaagattgtaagccgattttcttcgctgatgatgccaatacacccgattattactatgctaaacgtcgccaattcaatgcatcaacagatcctttcgaacgttcgattatttttttatatttgaaccgttttgggtttaacggattatgccgttataacagcaagaatgaatttaatgtgccttttggagcttacaaaactcattattttccagaagatgaattacgttatttcgctcataaagcgcaaagtgcggtatttttatgctgtgattttcaaaaaacttttgaatttgccgataaggattcggtgatttattgtgatccaccttatgctccgctacaacaagagactaattttactggttatgcagggaatgagtttggactagtgcagcaacgtgctttggcagatttagcgaaatctatacaaaaagaaaaacaaatttcgatattgatctcgaatcacgatactaaatttacgcgtgaaatttataacggtgctaaatttaaacgggtaaaagtccaacgttctattagccaaaacccagaaaaacgcgtaaaagtgaaagaattgattgcgatatttggtgctcgtaaataataaaaatagcccttactttatactaaaagtaccaaaatcgtaattttaaaaccacaataaaataatatattgtgtattaccatttatctcttacagtacctatatacttttttgatactaacccaaaatactcacaagtctgtaattttacctgtaatccttttgttttatcagaatgattatctagaaaactcatccaatcatcagaataattattatcctatagtagaatgtaaattattttaataacgccttatttgtactgtggataattcatcaaaatttaagcctgttatgctttattctttagtgtataacaaataggataaaaatggaaaaagcaaaaccatccaagcaaagaaattttaatcactgtcaaggagtacattattgaatttggtaataaaccgttaggtttaaaagatactacacccaaatgccactgccctatttgtgctcaagttttatttgagaaaaatgttaatacagtgccatcctctaatagcaatttttctaattacccaaaaagcgaattctgccccataaaattaaactaaagcaatttataccaatcatattttccattatcaccaaataaaacgcatggactgaattaaaaaattcattcagaaaaaattggcaaaaatattatcgtcaaattagtttttcggcaaaaaacttataacctattgaatttattatattagctaatcaacaaaaaatttgggaatacaataaacttgaagagtatcaaattccttatattctattaacattagcagactgtcctaaccaaaaaggaacatataaaaataaacgtcactgctggtttagattttggtttgatgcttcaattcaaagatatgaagatatttggaataatagttctttaccagtattgtggacaacctattattacctatcagggaaacaaagaaaaccttcagaaataaatctaaaaaacatgaattatttcatcatggataaaactttcttagaacaagaaatattacttccccaatttattattcaaaatatagaacggtggtttaaaacacacaattttgtatagacaagtcagcacctaatactatttcatgacgaagatcgcctttttctttaaaaaggcaaaaataatgccattaatcaaccatgccagtaatgtcgccaccaataaatctattgggtaatgcatgcctaatcgcacacggctaatcaacatcaataagccccacactgcaatacccaccaccagcaattttgctttaaaagaacggttacccaataattgggtaaagccaacagcaagcattagccaagttgccgcaaaaatcgtatgtccagaagggaacgaataccccgtttcattctcataatgatgaactaaccaagctggtgtgatagcatccatcgaataaaaattcttagctatttcagcacgcaaagtgcggtcatttttataaaagttttcaggcgttgaatgagtttgctcagctagataaacggtaaacggacgaggttcttcaaataatgcttttgcccctgtttttgccgcttgagttgcaataactgaaatccccatcacaattacgcctaatagccattgttttggatttttaaataaaaacgcaaacaaaagcgtaaataacacacaggtaatcaacgcataaggtacgctacccgtttcagtgagcaaataaagccaataatcagcttgagttaattggctattaccatgccattgataggaaataccccaaataaaaaatggtacaagacaaagtaataacgtatataatgacagccttttgaacatgctcgccccttgataataaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtcttaatttatcatcgtgaagaaggtcgcggaattggtttgattaataaaatccgtgcttattctttacaagataaaggaatggataccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccatgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaacaaataagatatgttaaaaaagccatactgttatattgaacagtatggcttttttatttaaactttatgttatggaataatcaaaagattttttagcatattgctaaaaacgagaaaccccgtctcgtattccaaagagcggggcttatcaggagtaagtaaaatgaaaaaaattgcctttttcattttcttgattatctgttgtttagttagctgttccggaacagttatctaagataatcgcaaggggacgatgtaggagttgtccccaatgcctccaatcttaaagaattctttccttgattgcaagggcaattattgactttgaacctttctccacaaatctttactgtaaatgacaccgacagaatttacttgagcacccattatactcggtgcaagataaacaggcgtactatattgaaaaatgggtaacactaaatgctcttgttgaactatcccttttaattttgcgtaattttctaaccgcacttttccggatgtcgtcgtcattgcactttcaaataaacgatcaaattccgcatttttatagccatttttgttatctgggctttttgaatagaataaatttagaaatgctgcaggatcattaaaatcagcacaccagccagaacgaattaattgaaaatcgccttttgtgcgggccgtttgcaattcttgccagctcatcccttgattttcaactcgtaataaatcagattgtgataattgatgatttaatcgcattgcaatggtttgattcagagatgaatcatcataacgaatacgtaatttcaatggacgagtttcactaatttgattttgggaaaagagctgttctgcaacaactggctcccaaacagattcttgctcacctagcatagattttggcaaaaaagtattgttaggataaagatgagcaatatctgcaaccaaattattggtagaaatcatcgaaacaatcgcttttcttaccgcacttttttgtaacacaggatcggaaagattaaactcatagaagtaagtacaaagttgcggataatcttggatattctgatcgacttttttcggattcattacaacatcaaaatcagacaaatctgcatctgctgcaattttttgatacttcacttgctgaaatatcactttttctttcgcccaataataaggattggtagttaaaatatgctgattttcagcctgactttgtaactgatatgcgccattactgataaatatttcagtcgatttagcatagtgaggcaaaagactgacatgtgccagcatagaaggtaaatatggcgatgctttatctaattcgatgcgtaaagtgcggtcattttcagcaaacaatcctagggattcaacaggtaacgctttttccaatactgccttcgcatttttcagattcataaaagccaaataatttttaagtgggctttcagattgagaaagtgtttgccaagattgtacaaaatctgatgcagtgataggctcgccatttgaccatttagcattttcacgcaaagtgaaaatccaagttttattgtcttcggtttgccaattttctgctacagctggaacaagattactttgcacatcataagccgttaatccttcaaaaagatctcgtaataattgagtttgttcttcgctttgtgcttgccaaggttgcaaagtcaaatcgctataaacgccacgttttaattcaactcggttagattctaattgagtatttttttgtgtctcaatttgtggcgaaataggcttaggactatccaatttatcacaagccaccaccgtaaaaataatagaaaaaataaccgcacttcgttggcacaaggcgaacaaattattcattttcggttttaatccaaaataagaagaaccaaaacttaatacaaatcaacgcaacaataacactacgccctattacacttggcgtgaaataaaaaccaattagtagcattgtggtagcaaaagtcaaaataaaaattttggtatttttctttaatgatcgattttcatgaaaggacttgagatgtttttgataaatacttgtgcctaaaaaccattgttctaagcgttttgaaccttttgtgaagaaaaataaagtaagtaataaaaaaggcgtggtaggcaaaagaggaagaaaaatcccaatgatgccaattgcaagtgaaagaaaacctaaaataatgtaaataattttcataatgttcctaataaaaaagaaaatgcaaactattattactgattttttagatttttcaaccttgatattatagaatttgccgtcacataaaaaaacagttttcaaaaaaggaacatttatgtctatgtcaaatccattacttcacattcaaggcctaccgccattttcacaaatcaagccagaacacattcaaccagctgttgaaaaattaattcaagattgtcgcaatacgatagaacaagtgttaaaacaaccgcactttacttgggaaaatttcattttgcctttaacggaaactaatgatcggttaaatcgtgcttggtcgcccgtttctcatctcaattcagtaaaaaatagcactgaattacgtgaagcctatcaaacgtgcttaccgttactttctgaatacagcacttggattggtcagcataaagggctttataatgcttatttagcgttaaaaaatagtgctgaatttgccgattattcgattgcacaaaagaaagccattgaaaattcactgcgtgattttgaactttcaggtatcgggctttccgaagagaaacaacaacgttatggcgaaattgtggcacgcttatcggaattaaattcacaattcagcaataatgtattagatgccacaatgggttgggaaaaactcattgaaaacgaagctgaacttgctggcttacccgaatccgcactgcaagcagcacaacaatctgccgaaagtaaaggattaaaaggttatcgttttacgttagaaatcccaagttatttgcctgtgatgacttactgcgaaaatcgtgcattgcgtgaagaaatgtaccgtgcttatgcaacacgcgcctctgaacaaggccctaatgcgggcaaatgggacaacagtaaagttatggaagaaattcttacattacgcgtggaattggcgaaattactcggttttaatacttacaccgaactctcacttgccacaaaaatggcagaaaacccacaacaagtgcttgatttcttagatcatcttgccgaacgtgccaaaccacaaggcgaaaaagaactgcaagaattgaaaaattactgcgaaaaagaatttggtgtcacggaacttgcaccttgggatattggtttttacagcgaaaaacaaaaacaacatttatacgccattaatgatgaagaacttcgcccatattttctagaaaatcgcgtgatttcaggattgtttaaattaattaaacgcattttcaatattcgtgcagtggaacgcaaaggcgtggatacttggcataaagatgtgcgtttctttgatttaatcgatgaaaatgatcaactccgaggcagtttctatcttgatttatatgcgcgcgaacataaacgtggcggtgcgtggatggatgattgtatcggacgtaagcgtaaactggatggcagcattgaaacgcctgtggcttatttaacttgcaacttcaacgcccctatagggaataaaccagcgttatttactcacaatgaagtcaccacgctattccacgaatttgggcacggaatccatcatatgctcacgcaaattgatgtatccgatgtggcgggtataaatggcgtgccttgggatgctgtggaattaccaagtcaatttatggaaaactggtgctgggaagaagaggctttggcgtttatttcagggcattacgaaacaggcgagccgttgccaaaagaaaaactcacgcaattattaaaagcgaaaaatttccaagctgcaatgtttatcttacgtcagcttgaatttgggatttttgatttccgcttgcatcacacctttgatgcggaaaaaaccaatcaaattttggatacacttaaatcagtgaaatcacaagttgccgtcataaaaggcgtagattgggcaagaacgccacacagcttcagccatatttttgcagggggctacgccgcaggttattacagctatttatgggctgaagtattatcagcagacgcttattcacgctttgaagaagaaggtattttcaacccaatcaccggcaaatcattcttagatgaaattctcacgcgtggtggctcagaagaaccaatggaactcttcaaacgcttccgtggccgtgaaccgcaattagatgcgttgttaagacataaaggaattatgaactaatacgtcaaactatagggcatgcacaacatgccctttctcaaatatttttctcgacataaaaacatagtaaattttaaccgcactttatccaaacaaaacctacaaacgagacattatttttacaaatagctgtaagataaacgcatagaaattcacgcagaatagactaatttcctgtataatttttcacatatctattcaactcattacacaaaatattctgaggattttatggctgctgcaattcaacaacgtgccgaacttcaacgtcgtatttggcaaattgctaatgatgtgcgaggctcagtcgatggctgggatttcaaacaatatgtacttggcacacttttttaccgttttattagcgaaaattttgccaattacattgaagcaggcgatgaaagcgtaaattatgcccaattacctgatgaaatcattaccccagacattaaaacagatgccattaaaacgaaaggctactttatttacccaagccaattatttaagaatgttgcggctaatgctggcaacaatcctaatttgaatactgatttaaaacagatttttactgatattgaaaactcagcgacgggctttccgtctgaacaagatattaaaggcttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgctgccaatgcaggcaaatctggtggtgaattttttaccccacaaagtgtttccaaactcattgctcaaattgcaatgcacgggcaaacctcggtcaataaaatttatgatcccgcagcaggttctggctcacttttgcttcaagccaaaaaacaatttgatgaacatattattgaagaaggctttttcgggcaggaaattaaccataccacatataaccttgcccgtatgaatatgtttttgcataacatcaactacgacaaatttgatattgctttaggcaacaccttaatggaaccacaatttggcgatgataaacctttcgatgccatcgtttctaacccaccttactccgtgaaatgggctggctccgacaatccaacactgattaacgatgaacgatttgcccccgcaggcgtgcttgcaccaaaatccaaagcggattttgcctttattttacacgcattaagctatctttcaggcaaaggcagggcggcgattgtctccttcccaggcattttttatcgtggcggtgcggagcaaaaaattcgtcaatatttggtggataataattttgtggaaaccgtgattgcccttgcacctaatctattctacggcaccagtattgccgtaaatattttggttttgtccaagcacaaaccaaatacccaaactcaatttatcgatgccagcggtttatttaaatctgccaccaataacaacattttagaagaggaacatattgagcaaattctcaaactgtttgccaataaagaagatgtgccgcatttggcaaaatccgtatcctttgaagaaatcgcccaaaatgaccacaaccttgcagtaagttcgtatgtggaacaaaaagatacccgagaagtaattaatattgatgaactcaatgctcaaattcgtgaaactgttaccaatattgaccgcttgcgtgccgagattgataagattgttgcagaaattgaggggtaaaatgtagggtgggcttcagcccaccatttacgataacaggtggtgggctaaagcccaccctacgaggaacaataaaaaaacaccatgaaaaacaaccgcacttttttagaaaaattattggatgggtctgaggttgagtggaagcctttagatgaagttgccaatatcgtcaataatgcaagaaaaccagtcaaatcatcctcacgagtgtcagggaatattccatattatggtgctaataatatccaagattatgtcgaaggatatactcacgagggcgaatttgtattaattgctgaagatggttctgctagtctagaaaattactctattcaatgggctgtaggtaaattttgggcaaataaccacgtccatgtagtaaatggcaaagaaaaattaaataatcgttttttataccattatttaactaatatgaatttcattccattcttagctggaaaggaacgtgcaaaattaacaaaagctaaactgcaacaaattccaatccccatccccccactctccgtccaaacagaaatcgtaaaaattttggacgcattgacagcacttaccagcgagcttaccagcgagcttatactacgtcagaagcagtatgaatactatcgggaaaaattgttaagtgaagaagaacttgggaaggttgggtttgagtggaaaacaattgatgaaatctcaaagaaaatttcttcaggcggaacgcctacaacatcaaataatggctattatgacaacggtactattccatggttaagaactcaagaagtagattttaaagaaatttgggataccaacataaaaattactgaagatgctctaaataattctagtgcaaaatggattcccgcaaattgtgtaattgtagcaatgtatggagcaactgtaggcaaaactgctattaataaaattccactaacaactaatcaagcatgtgctaatatcgagattaatgataagttagcttgttatcgctatattttccattatttaactagtaaatatgaatacattaaatcattaggaagtggctctcagaccaatattaatgctcaaattatcaaaaaactcaaagttccagttcctccaatcgaagaacaataccgcatcgtttcaatcttagacaaatttgaaaccttaaccaattccatcaccgaaggcttgcctttagcgattgaacaaagccaaaagcggtatgaatattaccgagaattattattgaatttccctagcagagaataatatgactaaaagtttagacaaaattgcaaaacaattaagagattctgataaaaaggttaatctaatttacgcctttaatggaagtggaaaaacccgtttatcaaaagtctttaagaatcttattgcacctaaagaaaatcatgacaatgaagaagatctaacacgaagaaaaattctttatttcaatgcctttaccgaagatttattctattgggataatgatctacttaatgacacagaaccaaaattaaagattcaaccaaattcttttattcgctggttgattagagatcaaggggatgaaggtaaagtaattggaaaatttcatcattattgtgatgaaaaacttatgcctaaatttgatatagaaaataatcaaattacattcagttttgcacgtggagatgatacgcctgaagaaaatataaaactatcgaagggggaagaaagtaattttatttggagtatttttcatacgttaattgaacaagttgttgcagaattaaatatctcagagcctagtgaacgcactactaatgaatttgatgaacttaaatatatctttattgatgatccagtaagttcattggatgaaaatcatcttattcaattagctgttgatttagcagaattagtcaaagatagtcccgatactataaaatttattatcaccacacacaatcctttattttataacgttttatacaatgaacttggagcaaaaaatggttatattctaagaaaagatgaaaataagaatgaaaacgaaagatttgatcttgaggtgaaacaaggtggttcaaacaagagtttctcctatcatctttttctaaaaaatctacttgaagaagttaaatctaaagatattcaaaaatatcatttcatgttactgagaaatttatatgaaaaaactgctaactttcttggttattcaggatggtcaaatctattacccaatgatgatgcaagacaaagctattacactcgtataatcaattttactagtcactctacgttatcaaatgagataatcgctgaaccaacagatgccgaaaagaagattgttaaatatttacttgaacatctaattaataattatggtttctatatagaagaaaatattaaagagccacaaactgataatataacagagtaaatatgaacgacttaatcatctacaacaccgatgacggcaaatctcacgttgctttattggttgtcgaaaatgaggcttggctgactcaaaatcagcttgcggaactttttgacacctctgtaccaaatataaccactcatataaaaaacatattacaagacaaagagttagatgagttttcagttattaaggattacttaataactgcccaagatagcaaacaatatcaagtaaaacattattcccttgatatgattctcgccatcggctttcgtgtgcgcagccctcgtggtgtacagtttcgtcgttgggcgaatacgcaattacgtacttatttagataaaggttttctattagataaagagcggttgaaaaatcctcaaggtcgatttgatcattttgatgaattactggaacaaattcgcgaaattcgagccagtgaattgcggttttatcaaaaagtacgagagttatttaaattatccagtgactacgataaaacagataaagtcactcaaatgttttttgcagaaacacaaaataagttgatttatgccattacacaacaaaccgccgcagagcttatttgtacgcgtgcaaatgccaaattgcctaatatgggtcttacctcttggaaaggtgctgttgtacgtaaaggcgatattattaccgctaaaaactatttaactcatgatgaattagattctttgaatcgtttagtgatgatctttttagaaagtgctgaattacgcgttaaaaatcgtcaagatctcacattaaatttctggcgtaataatgtcgataatttaattgaatttaacggttttccgttgcttatcggtaatggaacccgaaccgtaaaacaaatggaaacctttaccaaagaacaatatgccttatttgatcaggtcagaaaacaacaaaaacgcatacaagctgataatgaagatttagaaattttagaaaactggcagaaagatctgaaaaagcaaaagcattaaggaactacttatgacccaatacaaaactatcgctgaatccaataattttatcgttttagatcaatataataaatttgtggaagaacctaatgctggttaccaaacggaagggagccttgagcgtgagtttattcgtgatttacaggctcaaggctatgagtatttacaagggcttaataatcacgatgaactgattaaaaacttacgtgttcaattacaacggttgaataatgttattttctccgatgcagaatggcaacgttttttagaggaatatttggataaaccgagcgataatctgattgagaaaacccgcaaaattcacgatgattatatttatgattttgtgttcgataacggacgcattcagaatatctatttgctagataagaaaaatcttgccaataattctctgcaagtcatcaatcaatttgagcaaacaggcagctatgataatcgttatgatgtgacaattttggtgaatggtttaccccttgtgcatattgaactgaaaaaacgtggcgtggcgattcgtgaagcctttaaccaaattcaccgttacagcaaagaaagtttcaataaagaaaattctctctttaaatatattcagatttttgtcatttctaatggcacggatactcgctattttgctaatacgactaaacgcaataagaatagctacgacttcacaatgaattgggcaacggcaaaaaatactctgattaaagatttaaaggattttaccgcaactttcttgcaaaagaatactttgctcaatgtgttggtaaattactgcgtgtttgatgtttccgacactctattgattatgcgtccgtatcaaattgccgccactgagcgtattttatggaaaatcaaaagttcatatcacgccaaaaattggagcaacaaagaaagtggtggctatatttggcataccacaggctcaggcaaaaccctcaccagttttaaagcatctcgtcttgcgactgaacttgattttattgataaagtcttttttgtggtcgatcgtaaagacttagactaccaaacgatgaaagaatatcagcgtttttcgcctgatagcgtgaatgggtcggaaagtaccgctgggcttaaacgcaatattgaaaaagatgataacaaaattatcgtaaccaccattcaaaaattgaataatttaatgaaaagtgaagaaaacctgtctatttatcaaaaacaggtggtctttattttcgatgaagcacatcgctcccaatttggcgaagcacaaaaaaatctaaaacgtaaattcaaaaaattctatcaatttggttttactggcacacctattttccctgaaaacgcattaggtgcggaaacgacaacaagtgtgttcggtacggaattgcattcttatgtgattaccgatgctattcgtgatgacaaagtactgaaattcaaggtcgattacaacgatgtccgcccacaatttaaagccttagaaacagaaaaagatcctgaaaaattaaccgcacttgagcagaaacaagcctttttacaccctgagcgtattaaagaaatctcgcaatatttgcttaacaattttaaacaaaaaacccaccgcttgaatgccacaggtaaaggctttaatgcaatgtttgcggtaagcagtgtggaagcagcaaaacgttattacgaaaccttacaaaatttacaggcagagcaggagcatccgttaaaaattgcaacaatcttttcgtttgccgccaatgaagaacaagatgcaattggcgatattccagatgagacctttgaacccactgctctaaacagtacggcaaaagaatttttaacaaaagccattgatgattacaatcactactttggcacgaattatggcgtagatagtcaatcattccaaaattactatcgcgatcttgccaaacgtgtgaaaaatcaggaagtggatttactgattgtagtcggaatgttcttaacaggctttgatgcccctacgttgaatactcttttcgtggacaaaaacttgcgttatcacggattaatgcaggctttttctcgcaccaaccgcatttatgacacaactaaaacctttgggaatatcgtcactttccgcgatttggaacaaaataccattgatgcaatcacgctatttggcgatgacaataccaaaaatatggttttagagaaaagctacgaaacctattttaatggtgatgaaaatcaacgtggttatttagaggttgttcaagagctacaaaatcgctttcctaatccaacagaaatcgaaacagagcaagataaaaaagagtttgtaaaattatttggcgaatatctacgtgtcgaaaatattttgcagaattacgatgagtttgcagcattgcaagccttacaagcggtcgatttaaatgatccgattgcaatggagaaattcaagcaagtacattatgtgaatgatgaacaaattgcagaaatgctgaaagtacccactttaccagtaagagcggagcaagattatcgttcaacttataatgatattcgcgattggctacgccaaagaaaagaagggaatgataaagataattcgccgataaattgggacgatgtcgtatttgaagtggatttattaaaatctcaagaaatcaatttggattatattcttgcgttaattttcgagcatcataagaaaaaccaagacaaagaggtgttaattgatgaaatccgccgcacagttcgttcaagtttaggtaaccgtgctaaagagagcttgattgtcgattttatcaaccaaacaaatttagatgatattcccgataaagcgactttaattgactcattcttcctatttgctcaagcagaacagcgaaaagaagcagaatccttaattcaagaagaaaatttgaatgtcgatgcagcaaaacgctatatcagcacttcattaaaacgcgaatatgccagtgaaaacggcacagcgttaaatgaagtattgccaaaaatgagtccacttactccacaatatctcactaaaaagcagacaattttccaaaaaattgctgcatttgtagagaaatttaaaggggttggtggaaagatttaaatttaatatatcaacaattagacatcttattaagacataaaggcattatgaattaataatacaaaacgtaatgatcaatatttaactagtcgtgataataaaaacagctccaatttatacttggagctgtttttatatcgataaacttattttttacgtgctaaaattcgatttgcacactctgctgcagctgttaagccacctgccatcataataatatctttaatcactaaacgaccaactccagataaataagggaaaccataggctggcgttggtaaatctccacctagattaggcacccaagcctcgggcgttgtgattaaaaatgacagcgtgactattgacatgccaaatgtcagtaggcctcctgctaaacctgccgttgcattccaaataccagctaaagtaagaataccaacagtaacaataattgctccaataatgtaagaagccgtataggtgccattttctttatgccattcgatgttttttgcaaccatctttccttcaggatttttgtgtagtgtatattccatcactaactctcctttatcattcggcactaaatttggccctttttcatacatatagctaaaaaatgggctatttgatacaaagtgggcaattccatctgcctcatattgacaaactttcaaaccaccgatccatgccattacaataaaaatagcaatacggataaaattaataaattgacgctgcattggtgcaacaattctcgcgacaaattcaacaaatgtattaaatactgacatataaatttccacataaaagtaaataaaattgagagcctaattctactcgctttaatattaaaaagcaaaatcaattccctttaatataaaggtaaataacggagaaatttgaaaagttttactaattaaaataaaatttgattttcccattttaagcctatttattatctttaaatcacatttaaataatctttacacaactaccttatgatattaaaatttacaaaatttaagcaaatcctccacatcttctaaccaaagatttccaatttcatcaatcaattctccacaattaaaaacatcagaatttttagccgcactttctaaagtatccgctaattgacgtaaatgatttaaccctaccgatgccgctgcgcctttaattttatgggcggtatcttctgtttctttcatattatcttttgataattgagccagataatttggcatagtttgtttgaataaagataaattttctaaaatttgtttttttccaagtgtttctatcagcgctaaatcaaactgttctgaaagctcattatcatcattcatttctataatagattcgctttcatctgcaaaaaattgctgtagacaatggtgtaaatccttaattgaaatgggtttacgtaatacgccatccatgcccatttctaaatattcttgctcgctttgcataacattcgcggtaaaagcaatcattggcggtaaaaaatcataaataccgttttcatagttctctcgcaaatattgggcaatttcaaaaccactcatatctggtaatttaatatcgagcaatagaatgtcgtaaacatttttctcaaataaagtaatcgcctgcttgccatttgtcgcaacatcaacatgatgcccaagtttttctaaaatagtttttgcaaccataatattgagatcaacatcttccactaaaagaatattcaaggatggtatatttttcttaacagattctttttcagaaatttcctgagcgtggagagtaagatggaaagtcgcgccttttcctcgctcactttcaactgttaaatccccttccattaactgagcgagatttttagaaatagccaacccaataccgctacccgcactttgctgacggctttctttcacttgataatacatttcaaaaatatgtttttgttcttcaggtgaaatccccattcctgtatctttcacaataaaatggtaacaatcctgatttctcataattttaagaataatatttccctgatccgtaaacttcaccgcattactaattaagttccacaaaatttggctcaagcgaacacgatcaagattcaaccaattaggcaaattaggttcaagctctaaagaaaaaataagatttttttctttggcgaggaaactagcaaaattataaatatcgtttaataaggcggggaaatctgttggctggcgatttaattcaattcggctggcatcaattttttccaaatcaataatatcgctaaaaatatagcctaaactgaccgcacttatgttgatagtttttaaataattacgctggagatcatccaattcatcatcaagtaaaatttgactaagcccgacaatcccattcaatggcgtgcgaaattcatggcttattgtggcaagtaaggtacttttatcacggctatttttttctaacttttccaatgcttgggataattttttctgagcagcaattcgctcggcgacctcattttccaatcgattaaccgagctagaaagatcaagacgagaatgttcaagtttttctactaataaagtgaaaaaataaataacaaaaggcgcagtgagtaagccaaaagttacagaacgaaaaatatctacccaagatatctgatgaacaataaatagactaaataaaatctgagtacaaagggctaaaaccgcgagaatcatcacgcctaaaagagaaaaacgaagacgcccaagacgaataacccaatccacataactctgagcaaaatatttgaaatttttcatcaaatctcctaaaacattattatcgttataaaaaaacctgtgcatataggctttattatatccataaagtaaaagagattgttattactatgtgtgcgtaagaaatgaaaaacttaatctttattaattatctgtttgactaaaatttgtaattcaggaataacttgctcttcaaaccaaggattctttgttgcccaaagctgattacgtggggaagggtgcacgagaggcataaagtgcggtaagaattgacgataatttttaacagtgttagttacattatctttattttcgggtaaataatatttctgtgcatattgcccaataagaatagtgagctgaatattaggtagattccctaaaatcattggatgccatctttctgcaaaaccttgacgaggtggtaaatcacccgatttaccttttccaggataatagaaatccatgggaagaaccgcaaatatcccagaattataaaaataatcgtaatctactcccaaccattctcgcagacgatcaccgcttttatcattccaatacaaacgagattgctcagcttttaacccaggagcttgaccaacaatattaattcgagctgttttaggcgccgaaaataaagggaaaattccacgttctgtaaaatctttattttgaggatcagcgataatacttgaagttatttcgtctaaatttttaagcataatgaaggagattagaaatgaatatataaagtctatttgaaaaatatgaaaaatcaaaactctaaatgatgtaaataggtatatttattaaaactatattgtaggcaatacaaaactaaaaacttgatattgaaatacaatctctattttctactttaatccttttcatgaaataatgagtaaattcccaaaagctaaaaccccatatctttcgacacggggttcttctgtttttatttaacttagataagcatttgataacctggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttcctctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtatttttattcaactaaacacttgattgcttttgttcaatcaagatttttttacaaaacaggtttgtttttagagtttccttttcagttctctctttcactttcctgtcttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagagccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattatcacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctatacataaaacactacttaaaaaagtaatgatgaattttcagttaagcacctattaagacttcaaaattaaaaaatatttttaaaacaagtcaatcaacaagtgcccacacagattgtctgatatattgttaaagagcaaaaaataacgacgcacttggaaacttaaaaaacttcacaacagtgcgtcgttatgtgcggtgcattatagggattttcaaatcccttgcaagtacttttttgtaaaaatatttaaaaaaatgatcttttgatggaaatataaacattttattaaaaagtgcggttagaatagtcaaacttttattgctattatttcttacgtaatgaaacttctccaccattaaatatctgaattttattgccacataatacttttaaatgaccacgttcatctatgccttgttcaatacctgaaataacgccttgctcagtaagcacctttacttcactatttgaaaacgcattatatgattgccatgcttgttgaaattcctcatcaataccattttgctcaaagatatttaaacgtgtatataaatgttgtataagtttgggtaataaggtttgtcggtctacatcaggatcaatttcacacacttccgcataaggctgactaatttctgtttgttttgacaacgacgcattaatacctacgccaatcactaaattgagcatgccatttttatgattagcaatttcaactaaaatgccacctaactttctttcatcaaacaaaatatcatttggccatttcacttgtacatttagcacttccgcaatcgccaaaccgatgactaaacttaacccctcaattgattttttaggatcaaacgtccaataaaaactaaacatgatttgcccagcaaaaggcgataaccattggcgaccacgccgaccgcgccctgcagtttgatattcagccacacaaagatcacctttttttaaggaaggaatattttgtagtatccactcatttgtagaggaaattatcggctgataatggatgccataaggaaaaagtgcggttgatatttgctgaggatttaataaaggaagcattggcactaagcgataatcttgtccatcaacgagaatatccaaaccaatttcacgtaattgttgaatatcttcctctagatttttagaaaatttttccaattcagaccgcacttttgtctgacaatccgctaaatatgtcaataacgtaaaattcatcattcattccttatggcaaatagtatgaaaatcatagcataaatcctaaaatttcgttttcaaaataaagtgaaatctgtataatctcgtcgcaatattttttaacttcaacttagcgagaatattgcaatgtcattacgcattaaacaagaagcccttacttttgacgatgttctactcgtcccagctcactcaacagtgcttccaaatactgccaacctttcaactcaacttaccaaagaaattcgcctaaatattccaatgctttcagcagcaatggataccgtaactgaaaccaaacttgcgatctctttagcacaagaaggcggtattggctttattcataaaaatatgacgatcgaacgccaagcagatcgtgttcgtaaagtaaaaaaattcgaaagtggtatcgtttctgaaccagtaactgttttaccaaatttaacgcttgccgaacttgctgaaatggtgaagaaaaacggatttgcgggctaccctgttgtagatgaggaaaataacttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcgtgtaaagatgaatttggtcgtttacgtgtcggtgcggctgtaggtgcaggcccaggtaacgaagaacgtattgatgcattagtaaaagctggggtggatgtgttgttaatcgactcttctcacggtcactcagaaggcgtattacaacgtgttcgtgaaactcgtgcaaagtatccaaatttgcctatcgttgcaggtaacgtagcaacggctgaaggcgcaattgcattagcagacgcaggcgcaagtgcggtaaaagtaggtattggtcctggttcaatttgtacaactcgtattgtaactggcgtaggtgttccacaaatcacggctatcgcagatgcagcagcagcattaaaagatcgtggcattccagttattgctgacggtggtatccgtttctctggtgatattgcaaaagccatcgctgcaggcgcaagctgtgtaatggttggttctatgtttgcgggtactgaagaagcaccaggtgaaatcgaactttatcaaggtcgtgcatttaaatcttaccgtggtatgggctcattaggtgcgatggctaaaggctcttcagaccgttatttccaatcggataacgcggcagataaactcgtaccggaaggtattgaaggtcgtattccatataaaggttacttaaaagaaatcatccaccaacaaatgggtggcttacgttcttgcatgggcttaactggctgcgcaactattgatgaactacgcaccaaagcggaatttgttcgcattagcggtgcaggcattaaagaaagccacgttcatgatgttgctattactaaagaagcaccgaactatcgtatgggctaatctttaaggtgggctttagcctgccttttgctgtttaaagtgcggttggtttttgcaaagttttaaataatatgaaccgcttacactatcaataataagagcattataaatgacaaatatccacaatcacaaaatcctaatcctcgacttcggttcacaatatactcaactgattgcgcgtcgtgtgcgtgaaatcggtgtgtactgtgaactttgggcttgggatgtaaccgaacaacaaatccgtgaatttgctccaacgggtatcattctttctggcagccctgaaagcacaactgaagaaaacagccctcgtgcacctgaatatgtgtttaatgctagtgtaccagtattaggcatttgctatggaatgcaaactatggcgatgcaacttggcggtttaaccgaaacttctgaccaccgagagttcggctatgcttcagtttctcttgaaaattccaccgcactttttgcaaatttaaacgataattcgaccgcttctgagccgaagttagacgtttggatgagccacggcgataaagtaacgcgcttaccagaaaacttcaaagtaactggcacaacgccaacctgcccaattgctgcaatgtcggatgaaaatcgtcgtttctacggcgtacaattccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtaggcgatgatgaagtgattttaggtttatctggtggtgtggactcttctgtggttgcattacttttacaccgtgctatcggcaaaaacttacactgcgtatttgtggataacggtttactccgcttacacgaaggcgatcaagtcatggaaatgtttggcgataaattcggtttaaatattacccgtgttgatgctgaaagccgtttcttaggcgaacttgcaggcgtatctgatcctgaagcaaaacgtaaaattatcggtaaagtatttgttgatgtatttgatgatgaatcgaaaaaactcactaatgtgaaatggttagcacaaggtacgatttaccctgatgtcatcgaatctgcagccagcaaaacaggcaaagcccacgtcattaaatcacaccataacgtaggtggcttaccagactatatgaaacttggcttggttgaaccattacgtgaattgtttaaagatgaagtacgtaaaatcggtttggcattaggcttgccagctgaaatgatcaaccgccatccattccctggccctggtttaggcgtgcgagtattaggcgaagtgaaaaaagaatactgtgatttattacgccgtgcggatgcgatctttatcgaagaattacgcaacagcggttggtatgaaaaaaccagccaagcattcagtgtgttcctgcctgtgaaatctgttggagtgatgggcgatggtcgtaaatacgattgggttatttccctacgcgcagtagaaacaatcgattttatgaccgcacattgggcacatttgccttatgatttattaggcaaagtgtctaaccgcatcattaacgaagtgaacggcatttcccgcgtcgtgtacgacatcagcggaaaaccaccagcgacaatcgagtgggaatagaaaatctctatttcagataatttctaattatttcagtaactttaataagtgcggttaatttttaccgcactttatttttgtttaaaagcccttctatgccaatcacaatgagacttaaccaaataggcacataagtaaaatagtcgcttgtggttatttgattatccagcacaaagacagctattaaaaaaagcagtatgggttcaatataactcaacaccgcaaaaatactaactggaatttgttggctggattttaagttggctgaaagcgaaatcgcactcacaataccaagtgctggtagcaataaccaataacgatattcttgcgtaaccaaagaaagcgtatcgctttgagaaagaatataaataaaacaaggaatcgaaattaaaataatatccaatgtaattccttgtagagcagggattttcatcaatttacggcttagataataaaatggataaaccgtacaaacccacaaacttgtccatgaaaaactttgagtgtgccataattcatgtgcaacaccgcaggcagccagtaaaagcgcgattttctgaataaatgataaacgttcttttaaccaagcccatcctaaaacagccataatcagcggaaaaagaaaatatcccatcgcaatatttatcccttcaccatttagcggagcccacataaagagccagaattgacttcccgcatctaatgtccccagtaaaaataaaacccaacgcgtccaactttttcctaacgttgtcgtgataagagacaaaagagagcggcaaccaatagtcgggaataaaattaaaagtaacccaaagatcatggtcagcatacgccacgcaaaaacatccgttccgctaagtggttggagccatatactaaataaatacaatatgccaaataaacattgtgaaaaaatgcacaataatacaccttgagtaactactttcattttgaacctcatctcatcaatgtgattattataaaatcccaagacaataaaaaatctcaactttattttttattgtgataatatttttctcgatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcgttattacaaaacgagttgcagttgtttccccaaaagccgttgggcgtacgattagcgtatttgtcatggtcgaaatggataatcaccattcttattatcaagagcaatttgaacggaaaatgcgtcaagaagacgaagtggtaagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatagaacaagtgcggtaaatttttaccgcactttgtgtatgattaacttagttttgtcgtctgttttaagaataaataaccaagtattgccgaaacagttgatccaagtagaatacctaaacgagaaagagtattgacactttcccccgcattagcatcaaacgcaaggcttgctaagaacattgacatcgtaaaaccgattccacataaaaccgcaacagcaaaaatttgtttaaaattaattccatctggtaatttagctaatcccaatttaacagaaagataactaaatccaaatataccgactggtttaccaataattaaaccgcttgctatagccaataataatggcgacgaaatcatattcacatctatgccagcaaaactcacaccagcattggcaaatgcgaaaagtggtaaaataacgaaagatgaccaagaggataaaatatgctcgaaatcatctaatgggcgttctccttttttacctttcaatggaatgctaaaaccaataataacgcctgctaaagtagcatgcacaccagactttaatacggaagcccataaaattgcacctacgaccatataagcgcaaagtgcggaaactttgaaacgatttagtaatatcagcacaataattgccacggcagaaaaaattagtgcttgtacactcaatccgtgcgagaaaaataatgcaataacaactatcgcaccgaggtcatcaataatagcaagggcaagtaaaaatattttcagtggaagtggcacttgtttactcaataacgccataattcccagtgcaaaagcaatgtctgttgccattggaattgcccagccattagctaaacttggatcttgtttagcgataaaccaataaactacagccggtataaccattccgccaatagctgcaatagcagggaaaatagcttgctgataggtagaaagcgcgccttcaaataattcttttttgacttccattcccactaatacaaaaaacaccgccataaaaccatcgttaatccagtgaattaaggttttattaattgagaaactaccaatttgtaaacttacaggcaaatttaaaaaatcattatattggttgcttaacggcgaattagccagcaacatcgcaacaacagctgaaaaaagcaataatataccgccagcagattctaatttaaaaaaacgttggatcagttttatcacataaacccctttaaaaatacatagcaaaaaattcacaaaggaagcatcctagcatattttcgaagttaaaggaaaaagtgcggtagattttgtcgggatttttagcgaattgtcgataaaatgccatatattgtgacaaaattcacatttttaattttacgcaatagagattttatctactttgtagtagaatgcggaccttttatttttagaatcaaaaactatgttttcacgcaaagatattattattttaggaatgatgatcttcgccttatttttaggtgcgggtaatatcatttttccgcctatggaaggattttcctcaggacaacattggacgagtgcttccttaggctttgttttaactggcgttttaatgccatttattacgcttgttgtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactaatttttaacttaatcgcgatgggctttatgattagcccaaatacgatcatttcaagcgtgggtaaatttatgacaccagctttattagtgttacttattgctgtggcaattaccgtatttatttcgcctttatctgaaattcaagcaccaagtaatgcttatgaaaatagccattctttattaatcggcttaaccagtggttatcaaaccatggatgtacttgcagccatcgctttcggtggaattgtcgcccgagcattatcagcgaaaaatgtgacaaaaaccaaagatattgtgaaatacaccatttcagccggatttgtttctgtcattttactcgccagtttatatttttcgcttttctatctaggtgcaactagtgctgcagttgcagaaggggcaacgaatggtggacaaattttctctcgttatgtaaatgtcttattcggttcagctgggacttggattatggcgggtattattgtattagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagctttgttattaatttacccagtagctattgtgcttgttttattgcaattcttacgaaaaaaacttccatcaataaaatttacatacaatagtacattgctcgttacggtttgttttagtttatgtgacagcttaaataacgttaaaatgttaccagaaagcatcaattcattattgaaacacttccctctttcatctgaaggaatggcttggttggttccgactttagtaatgttagttgcaagcatttttattggaaaagcattgcataaaacccattcttaatctcacaaagtgttttatttatcagccctgtgccgtaaaactccgtccttcagggcggagatataaggcacagggctgataaatttctaaccgcactttttcaaaaattaaattaatttaacaggtacttttacgactaattttttaattttttctgtttttccattcactacacagcaaggcttgtgcggttcataaggatagaatacagcgaacatttttggtttcattgtgacggtgaatttatcatcaatatctgcacaaagttgataatcatccgcttcgttgtaatcttcatacttagataaattcggataggttgcgcccacttcgatattttccgtgccacgaataagcacttgtacatctaagtattcatgatgtaattctgcttttttactgcttggttctgcagtttctggttccattacgttcatataaatttgatcgttaatatcatggcgaccattctctaacgcattcaaatctaacgtatttaaataatcacatacttcagcaatcacttttggcaaaccaactttaaaatttgggttggttaaactgctaataatcatagaattttccttatagtggataaaagttacactatgataccaagtcggttaaatgaaataaagccaccgattacatcatctctcttgattaatccaattagctcttgtagtaccgagtgaaagagagcaaatatttgccaacttattgacgcataaagtctaaacaatgaaattacggcattaacacaagcattttcagaaaaaatattatcaagaggcttatgaggacctgtaaaatgaaaaataacaagagaaatatcaagagtattaattgaaatcatatgaactaattgtaatgttgaatagcgtttagcaaaataaagttgaagatcattttgccacgattcagaaatatctcctgtatgtaaaataaaaacagagagattttcattgtgcattaataaagatttcagtgtgatttctacataaggaagataattagcatcactagccatcattacattatatttcatataaaagaacctaatttcagagagaacaatcaatttttaggaggaaaatactgtcgaaacaatgataagaagttggtaatgtgaaataaagttagccattaaagccaaacatcctgtataatgcacgggctttattttctacattagcgtgcggctatcaaaagaaatttttaaacgcccaaagtgcggtcattttttcgaaagatttcttttgctagtcgcaatctgggaaataaggcattgtttttaatataaattttaaggaaaacattgtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcaaaacgtggtgtagcggctgttatgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaataatcttggaatatagaatcaaaacttggtagcattcgctgccaagttttgttgttttccaacttttaggcataaagaaagcaaatgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgtgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattatgacggcgcattggatgctttcaatacggtgtttgaattagattcaggttatgactatacccaccttaatcgtggtttaaatttttattatgtagggcactaccatcttgctcagcaagatttcttacagttctaccaagccgataaaaaagatccctatcgtgtcttatggctatatttgaacgaacaaaaattaaaaccacaagaagcccaaacaaaccttgttgaacgagcaaaagggctatcagaggacttctggggtacacacatcgttcaatattacttaggacacatctctgtagaagaattacaacaacgtgcaagtgaatttgccgaaaattcacaacaatatgctgaaattctcacagaaacctatttttatctagcaaaacaaaaactcaatgtagggctagtagatgaagcagcagctttatttaaactagccatggcaaatcaggtttataactttgttgagtatcgttttgccgcgtttgaactcatgaaattaaaaccggttcaaacagaagacgaaaaagaagagaaaagtgcggtaacaaaagcgattgttttctaaaaatcaatccaaaacttaccgctctttgcagtagaacgaatagaaaaattcattcgctctgctcaacttaataaaccgaaagcccgttgagctttccttatttatattcgagtattttaatgactgacaaaattacttttaatgacttaggcttacctgagttcatcttaaaagctgtttctgacttaggttttgaaaccccttctccaattcaacaagcttgtatcccacatttgctcaatggcaatgatgtgctaggtatggcacaaacgggtagtggtaaaaccgctgcttttgcactgcctttattagcgcaaatcgatccaagtgaaaaacatccacaaatgttagtgatggcgcctacacgcgaacttgctattcaagttgccgatgcgtgtgaacaatttgttaaatatgcacacggcactcgcattgttaccttatatggtggccaacgttatgacatccaacttcgtgcattaaaacaaggcgcacaagtggttgtgggtacaccaggccgtattcttgaccatattcgtcgcagaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagctcttcttcgtttcttagaagtggaagattttgatgcagcgattatttttgctcgcactaaaactggtactttagacattacagaactacttgaaaaaaatggtttccgttctgccgcacttaatggcgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgctggtcgttctggtcgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaagatattgctgcagcaatgttgatgctgcttcaaggcaaacaaaaattaattcttccacctgatccgccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtagaagttcgccatatcgttggtgcgattgctaacgaaggcgatattaacagccgttatattggtcatattaaactttatgatgactacactaccgttgaattgccacaaggtatgccgaaagaattattgcaacaattcgctaaaacacgcgtattgaataaacaaatgcaaatgtctttcttaggtgcagtaaaatccgataattcccgtggcagcgatgattttaacggtaaacgtaaaggtcgtggtggcgatttccgtggagagcgcggacgtgaacgaggcaatgataatcgtggcaatcgtaaatttaatgaaaaaagtaaccgcacttttagcgacaaaccacgccgtgatcgtagatcatcattctaaaaataaatcgtctgatattttacatacacttagccccttgaacctcaaggggctttttattgcctatagtgaaagttttggctacaatcccataacttttttatataggaaaaatcattgaaaggtctttttttacgtattattactgctctagcgttattattttgggctattgatatggtgttcccatggcaatttttacgtcatactgaagaaaatcattatactgcaattcaagctaggggatcactttatgtaggaacaataaataaccagatttcttattttattaataaagatagcgaacgaggctttgaatatgaattagccaaagcatttgctgatactttaggcgtagaactcgaaatgaaaattttcgataatcaagagcagttatttgatgaacttgataaacacaatattgatttagctgccgcccaccttttataccatcctaaaaatgcagaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaacttggaaaagaaatcaagcacttactcaagaagaactattactacaactggctgaaggcaaaattccttacgttattgcaaattctattgatattgctgcaattcaacaaatcaaaccagaattagccattgcctttgatattactgatgaagcaaacgttcactggtatttacccaatagcccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagaatatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggctcaatgtgaaaaaaaatctgcctttattagcagaaaaacgctattattcccaactgaaatacggctatgcaagaggctatgaagcctatcaatatgtagaaaatattcgccgctatatgaatagcatcgtaaattatcatcgagtccaagaaaatcaaacaacgaatgataatgccaacaacgaaagtgcggttaaaaatttagaagaaataaaagaaaataaggattaataaaatgttaaaacgtaaaacttttcttaaaaagaaagctaatttacaacaaagttctttatcacgtaatctacgtttaagacgtttaaaacaccgcaaacaacaacaattttcgagacattcattacaatttgtcgtacaagaaatttgttgctaagtaatctatttttcttatcaaaataaagaaaaaataaccgcacttttttatgtaatttatatcattaaagtgcgatctttgttttacaataatcgtaaaatatagtgtgaaattttatagattaatcaatattttattctaattttatccctaagtttccaattttcacaccgactagaccaatcgagacgggatcaaaataatcccctaaaaatttgaacaattcatttaactctgtaaaagaacgctgaatttttatttgatcctccactttacgcacaaattcatagcgtatgttattttcttcaaaataagctgttagagttaaataaatcgtttcaaagaaatggcttttggccccctcctctccgggatcactaatacgcacattccacgtattattaagtagaatttgaggctgttttgacatattttactccttgctatttttaacctaagaaaaacccgattataaagtttctgtaatcaaaaaaatttataatcgggcttttcaaatattttccctgggtgtttcgccttacgttggtaactgcctttccctttacgttttttctcaacacgctgacgaaataatttatcgcctagcaatgccatcactgcattatcttttatcacgcctcgagtgtgcaaataaacggtttcattttcaaccgcacttttttgtttctttctcataaattttccttaaaaaagccgcggaaggatttccacggctggtgtactatacatgcaaacgtttaaattacaaaatctcaagtacagtttctggcggacgcccgattttagctttatcgccattaataacaattgggcgttcaataagtgctgaatgttcactcatcgctttaaataattctgcttgagaaagatctaaattatctaaatttaagcttttatatagttcatctttcgtgcgcatcatttggcgaacatcatcaattcctaattttttggcaatgctttgtaattcattaacggaatactgcttttgcaaatacagttcaataatcggctgaatacctttattttctaataatgctagcgtttcacggctttttgagcaatgtgggttgtgataaataataacagacataggatttcctcttagtagctataaacactgtaaattttaacttataatggcaaaaaaatacttataggaaaagaaattatgctagaaatgttaaaaagctggtactctcgccgtttaagtgatcctcaagcgatgggactattagcaatattattatttggctttatctccatttatttttttggagatttaattgcgcctttgttgattgctctagtactatcctatttacttgaaatgccaatcaattttttaaatcaatatttaaaatgcccaagaatgttagcgacaattcttattttcggtagttttattggtctagcagcagttttctttttggtattggtgccaatgttgtggaatcaaactatttccttattaagtgatttgcccgctatgtttaataaatctaatgaatggctactcaatttacccaaaaattatcctgaacttattgattattcaatggttgattctattttcaattctgtgcgagaaaaaatccttggttttggcgaatctgctgtaaaactttctttagcctctattatgaacttggtttctttagggatttatgcctttttagtgccattaatgatgttttttatgttgaaagataaatcagaacttttacaaggggtaagtcgattcttaccaaaaaatagaaatctcgcatttaaagtatggaaagaaatgcaacagcaaatttctaattacattcacggaaaattattagaaatactgattgtcactttaatcacttatattattttcttaattttcgggctaaattatccactcttattggcttttgcggtgggtctttcagttctcgtcccctatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattattatcatttcagtattaatttttggcggtttatggggattttggggtgtattctttgccattcctttagccactttagtaaaggccgtaataaatgccttacctcaagattaaataatctttgaattttaagtactttatttaattagagatttatataaataaaaaatagttaatcgtaaattttcgattaactatttttttaatttattctaaaagtaaatcaactaaggtaattcatcaatttctttatctactttaggtgggatcatatgttcacgacgtaaaccaacatcgtatgcaatggcgatggcaacaaaaatcgaggaataagtaccaaatccaatacctacgagtaaagcaagtgaaaagttatgaatggaaggaccaccaaagaagaacaatgccatcacgacaactaatgtagtaaccgaagtaatgatagttcttgataaagtttgcgttaaagaaatatcaataatatcaatcgtatccaatcgtctaatttttcggaaattttcacgaactcggtcaaataccacaatactatcgttgatggagtaacccaccacagataaaatcgctgcgacaaaagtaagatcaatttcaatttgtaatgcagagaatacccctagcgtaataattacgtcgtgcgcaagagaagcgatactgccaaagcctaaacgccattcaaaacgtgaccccacataaataagcaccattgctaatgtcgctaaagtcgcatataccgcaccttgtgctaattcttcaccaacatttgggccaacgaactcaatactgcgaatttgaatgtctttatctacattctgtagcatacttttgacgtgttcaccaatggtagaatcattattacttgcaggtaaacgaatcatcacatcctgaaccgatcctgtggtttgaacaactggactttcaattccattttcgtgaagtttactacgaatttgttcaaggttagcggactgcgagaagtgagtatcaaataccactccaccagtaaaatctaagccccagttaaatcctttggtaataataaaaaatagagaaattaccattaaaagtgcggataatatataaccccatttacgcactttcataaattcagtcaatgggaacgggagctttatcccattgatttcacggataaaatgtccgtctttatcttttgtaaaaagtttcatcatttcccgcctaaattaataattttttaagttgtttgccgccgtaaagggcattaactaatgcgcgagttccagtaatcgcggtaaacatagaaatcgcaacaccaagtgaaagcgtaatcgcaaaaccttgaattgggcctgttcctaccgcgtatagaataattgcggttaagattgtggttaagttagcatcaaaaatagaagtaaatgcaccgttataaccttcattaatggcttgctgaattgaacgaccattacgaatttcttctttaatacgttcaaaaatcaatacattcgcatctactgacatacctaaagttaaaacgatacccgcaatacccggcattgaaagtgtcgcaccgggtaaaatagacattaatcccacaagtaatacgatattaataacaagtgcaaaacttgcaatcacaccaaacattttgtagtaaaacaacataaaggcaataacagcaactaatccccaaagactcgcattaatcccttgctctacgttttgtgcacctaatgatgggccaattgtgcgttcttcaacaatttgaattggtgcaattaatgcgccagatttcaacaaggtagaaagattatgtgcttcggcaatactatcaacaccagtaatttggaaattagaaccaaaacgaccttgaattgttgcaacattaataacttcttcatgcttttctaaaatggttttgccattttcatcttttttgccattatctttatattcaacataaagcgttgccattggttttttgtaatattttttagtggtctgagacataatctcgccaccttcgctatccaaggttacactcacttgcggcgtgcttgaatgctgatctaaaccagagcttgaattaatgatatgctccccacctaatacggcacgtttaaataatgcaacaggatgcccttggcgatcatatttaacttccgaatcagctggtaacatattacgagaaatagcatcagctgtaacattttgatttacgatacgaaactcaagtgttgccgttgcccctaaaatttcttttgcgcgtgcagtgtcttgaacacctggtaattcaatcacaatacgttcagcaccttgacgttgaattaccgcttctgcaacacctaattcagcaacacgtttacgtaaaatcgttaagttttgctcaatggctaagtcgcgtgcttcatttaatgctgcagtagatagccctaaattaatactatcagcatcaggctcagtaatgtctaatgttggatgtaattggcgaataattcgctcagctttagcacgctggctcacattagctaaggttatcaacgtaccaaaatgctctgtatttttaatggcagtatattgaattttttctttgcgaagttcgccacgcaaactgtcttgtaattgctcttggcgttttacaagtgcggcattcatatcgacttccatcaaaaaacgaaccccaccgcgtaagtctaatccccatttcataggattcgcaccaaacatacttaaccaagctggagtggctggagcaagatttaatgcggtggtgtaattattgccaagacgttcagcaattttatctttagcaagaagttgatcatcggtattagtaaaacgagctagaattgagccattctcaagcacgatagatttggttggaagattattggttttaagcacatcttgaacttgtccaagcacgctagtatttgcttcttgaccgcgcgtaccggaaatttgcaccgcaggatcttcaccataaatatttggaagagaatataaaatcccgatggccacaataaaaataaccatcaaattcttccataatggataacggtttaacatagttttccttttcttttctaacgcacagagccacaatgcgtggctctggaaaataatttaacgttactcttaaagtgattttaatgaacctttaggaagaacgctcacaatgtagttacgattaatcgtaatttctgtcgtgtcgtttaacgcaatcacgatgctatcactaccttcggttactttagtaattttgcctattaaaccaccagcagttaaaacttcagtaccttttgcaagctcagacatcaattttttgtgttctttattgcgtttagcttgcgggcgataaatcataaagtagaaaattaaaccaaagatcacgaaaataaatagcgtggacattggactttgtgcttccattgtgttttccttattaatttaagttaaaaattttgcgtaaaataccataaattgcttcattgggaaaggcgaactaagcccaatatcctacgttatggcgattaattttattttttcaagataacgataaattctttttccgaagcgtaatattgctcgactaaagcaacagaattttcttcggcaaaaatagaaaaattttccaccgcactttcaaggtttaagatcaacattagctcatcatttttattcaaattttttaaggcttttttggcacttaaaagaggaatggggcatcgaagtgcggttaaattgagctgatatttcattctttaacttgacgacgagcactcatgcgcttgcccatttcagtcaaaatatccgcacttaagcattcacgccccatttcaaataacggctcttctaacgcaatatgacgatcataaccttgaataaagcgttcaattaaatattcatcaatattttgacgttgttcagaaataagctcttctaactgcacagataatgcattccaattttcatgcaaatattcgtgctgtttttctaattcatcaatggaagtttgtgcttgcggagccactttgactaattgagggaaaaaatctgattcttcatcatcgtgatgtaacggtgcggcacgattgaaataagttaaaatttgctcaacatcatttaacacagcctgagtatagccgtgtttttctagataatcaggcaaaatgcttaactgacgacaaaaacgttttactttactatgacaagcataaagcatttcaataggttcattccatgtggcgaattgttgaggttcaagaatttgcataaggtttcctttgttaaaaagtgcggtcaaaaaacgcttcatttttctaccgcactttcatcaattatgagttatccgctaattgtaatggtggaacaggtttgcccatgcgagcatagaattccaccacaaaatcatcaaaacgatcatcttcaatcgcttgacgaatttccgccattaaacgttgataatagcgtaaattgtgaatggtatttaagcgtgcacctaaaatttcaccgcatttatctaaatgatataaatacgctttggtgtagtttttacaggtgtagcaatcacattcaggatctaacgggctggtatcatcacgatattttgcattacggattttgacaatgccgtctgtcacaaataaatggccattacgtgcgttacgggttggcattacgcagtcaaacatatcaatgccacgacgcacgccttccactaaatcttctggtttacccacgcccattaaataacgtggtttgtcagctgggatttgtgggcagatgtattctaaaatgcggtgcatatcttcttttggttcgcctaccgctaaaccgcccaccgcataaccgtcaaaaccaatattgactaagccttctaatgagactttacgtaattcttcaaatacaccgcccttggataataccaaatagggcatttttattgcctaattcatcaaagcgatcgtggctgcgttttgcccaacgaagtgacatttccatagattttttcgcataatcgaaagtcgctgggtaaggcgtacattcatcaaaaatcatgacgatatcagaacccaaatcatattgaatttccatggatttttcaggcgaaaggaagattcgctcaccgttaattgggttttggaattttacgccttcttcggtaattttacgtaatttacctaaactgaatacttggaaaccgccactgtcagtcaaaatcggacgatgccattgcataaaatcgtgcaaatcaccgtgtttacgcataatttcttgacctggacgaagccataaatggaaggtgttacccagtaaaatttctgcacctgtcgcacgcacttcttctggtgtcatgccttttaccgtgccataagtacccactggcataaacgcaggggtttctacactgaacgtgccttgtggacgttcaaacaccaagcgaccacgacgagcattgccgcttgttttatctaattcatacttcatttttgctccaacgaataaacagttcgaagatttttttgaacaaaaaagcctgttaaaaaatacaggctttgtgatatcatattttcaatgctctttgagcagaggcggatctactaagatagtccgccagttgccgctgtcgggctatttcgtagatcctgagtttgttaatcatactaaggataaaaatatgactaaatttatgattaagttggtcatcattattctactttgcctgttattgaaaagtagcactggctattagtagttgatgccgacaagagatggttaccgccatctcttgttctttattgtaggtgctgactaattacaagtcaaacaacttattccaactctctcacattagaatttttattaataaacatcgcatcgccataactaaagaaacgatatttttcttgcactgcatgcttatacgcattcatggtatttttataaccagcaaaagctgaaactaacataatcaaagtgctttcaggtaagtggaaattagtaattaagcaatccaccactcggaattttttccctggataaataaaaatagaggtatcagaaaaataaggctcaattaaatctggattgccaaattcttccgcagaaagtgccgcactttcaatagaacgaacagaagtagttcccactgcaattacacgtttgcccgctttctttgttgcgataatcgcattgcaaacttcttgagaaacttctacgtattctgcatgcatcacatgatcttcaatattttccacacgaacaggctggaatgttcctgcgcctacatgtaatgtaacaaattcaaaattcacaccctttgctttgagtttttcaagtaaatttttatcaaaatgcaaaccagccgttggtgctgctaccgcacctggtactttactataaaccgtttgataacattctttatcggcttcttcatctggacgatcgatataaggcggtaatggcatatgcccaatggtttgcaacacatctaaaagagcggttgatttatcacttaattccacttcaaacaacgagctatgacgagctttcattactgctttaatgccattattttcgcctaatttatcttcccctaaaaataattcagccccttctttaggggatttcgatgaacgaatatgcgctaagaaacgatgttcatctaacattctctcaactaaaacttcaatttttccaccactggctttacgcccaaacattcttgcaggaataacgtgcgtattattaaaaatcaataaatcgccttgatcaattaaatctaatacatcagaaaaagtgcggtgaaaaatttctccgttttcaccatttaactgtaataaacgacaagaaacacgatcagttttaggataacgagcaattaattcatcgggtaaatcaaagttaaagtctgaaacacgcataataaaatttaggttaaataaaataggcggtaagtctagtttgaattgaaaatgatctcaagaaaaaaactttcctcggggaagataaaataaccagcaattatgctggttatttgggattaattataaatttgcttttttagttgcttttacgtttacatcacaatttttaacgatgatgttatcgctagatttacctttttgaattaaatttacaggcacaacagaatcaaatttatctaacgttaagccactatctacattccaaacataatccccagaaacgaaacttgtaaagtcattttgtgatttatcacgagtaaaatctttcgcaataatgccatcgcccacacttaccattgcggcaactggttcttggttttcaaattgatacacagcagtcaccgtttgtttattgcaggaatatacaactgttttatcagttattgttggaagtgtttgcatttcagctatttgcgcagatgattttgtcatttcaggtgcatcctttgcacaagcagataatacgactacagcagcaaatgtgggtaaaattttagttaaattcattattaaatcctcttaattaatccctatatagggtgctacttagatacctttaataaaataaagttccattattggaataaaaaaggtgggatttgatctgccccaccttgtttatcaataaacgataaaattatgttgatttttaccaacgataccccaatttcacgcccacattttgctgtttgccgagttgtgaaccttgagattttgagataaaagcggaaagttggaaatgtaaaatttctgcctttaatcccacttctttttgccaataacgcccaaatgattgttgcaacatcgtgctatttacagtggtttgtacgttagcgtttgaaacatcaacataattaacgaagaaataaggcttaacgctgatattatctgtcggggtaaacgtataatcaactcgaatgccagcattatagcgattaaatgcaaggctcggtgtttgcactttcacgtcttcagattgataattttcacgttcaataaaatatcgattaacacccaaataaggctgaatacccaattgccctaaacggaactgataacttgcattcacaccataatttatcgcttttcgatgaatttttcggctttgttcttcagccattttactcgcactaattcccgcgcccacgtttacaccaaattgtaaatcgccccattgatattgggcgaaacccgacatcatcgttaatgtcgcgtgatttttaacctgttcgtcaaaggtattatctgaacggctatgcgagaaaaccgccccaattcgtccattatctaaggctttttgcaccccaatttgacgcaagttcgttttctgctgataagcacggaacgcatcagaatcatagcgtcttttatcctgtgcgatatttgtccacacagcagattgtgcttgatctacaaaaagacgatccaattcatcttgaacggaaagcatactatttactgttgcagacaactccgataacgcactatttgagtaacggctgatcaagtctttttgtttgccttgtttctcttgagcttgacgttcttttcccacttgcggttgggcattaataacctcaagtgcggcttttaatacgtctaactggctttgatcaggcgggggatcagaaaacaccgctctcaatgctctttttgaccgcgctttttttgtttttgccttacttttttgtgttttagcattcggttcagcttgtttggcttctaatgcgtttaacaggctttgagcaggcagggtatcaggcaacaccgctcttcttaaccgcacttttgccttacttgtttgtgtttcagcagtcggttcaacttgtttggcttctaatgtttgttctgcttgctctgctcttactaaatcattgtgcaattcctgctcttttattggattatgcaagcggaattcgccattattcttcactaatacataacgtaatgcacccgcatcaacgtggtcattttctaacgtgaatgtgagtttgtctgataacggttgattatctttgctttcaaccaaagttaattgctcaagggtttcgggttctttgcctgtgttgcgaacagataatatgtaatcgccctcagcgtcattggataattttaatttatcgcttttatagccaaataaagatgaagtaaattggaatgtgccttgcccgctcaatttaccatttactgtcaatgtgttgaaacgatgttctgccgatgttggcgtcgtttccgtctctaatgaacggcgacgacggcgtggcgtattgtttggactagctgaataagctgaatttaacgtaacagtactgttatttagtgttaaattctgcaatgtggtatcgctaggcattgtccaagtcgcattttccaacgtcactgttgtgcctttgtcgccctgaatttggtgcgaaagatggctgttttttaaataaaattgagcagaattcgttaaatgcacattaccgttcaagtttgcattatccaccgttgcagttgaattgtcggaaagtcggatattgcctatttgggtagcattgttgcttaatgtaaattggctgtgatttgttaaagtgacattgccattaagttttgctaaacctttaacattcgccgttgcattatcagttaaattaatagagccattgatttgtgttgttggtatagaattaataacttttgtgtcggttaaattctctgttttacaagtcgttaagcctgtccaatctgaacgcgtgcaaatggtattttgttgatttggcacaacaccaaatgtggcgttggcgttattgctgattgtccaatttccctcaattgaagaaacattgcgagaaaccaccgcacttccgcctttaatttggaagttttcagctttaaatgtgcggttgatccaatcgtcatcaataaccacttcgccttgaggtcgcccaagctcgtttgggcgatttaaatgattgtaagcgtgtggcgttgggcgaccactaaacactaaagtgccgccttcttgagtaatatcgccttttaagtttgtgccacctgaaagtagtaaagtacgatcttctgtggttggtttataaataaggtttaatcgtccattgtgtttattttcatctgtttcgccaaaccaaccgttgtaggcaatttctttgctgtaattaagtttattaatattatttccattaggtagaacaatgctttcgttcccagtaatagtgacattagcgacttcagttgtattatggttcacaatcatcgccccctcgtccgtattttggatacgtttaaaggttaatgaatgcccattaagatctaagcgaccaccacgaaagccgaaataaaatttatcggtatcaaattgtttatcatcgtttaattggacagtccctctgccgctaaccaatccgatttcactaaaggcttgttttttatgttgatcgtcctcttgttgttctaagattactttaccatcgccaacgctaattgagcctaagtttttaccttttgcttgaatatgtaacgttcctttaccaattttagaaaggcgatcattttctacgccattgactttccaaattacggtgctttcatcactgatagatatccccgcccctttccacgtttcattatgggtaggcgaaactataaaatctccctcaaaatacaaaccgcctgcaccttgatcgatattattactaaaagttagcaccccttttccgtaatcaataaaataaaggttttcgccgtgacttaatgcgggagaataattgtttacaccaccattagtatagacaggctccgtgcctttcatagataaattgtaattagcaagtttgactttataaattttaccagctccagatgtaatagtgcctgacccatcattttttgaatgaaatgtgtagtgctgattttgttgatttttaggagttctgaaatcaaatatggtcgttttaagattagcagagaaaatttcatcaaaataatttttacggactagctgaaaagtattctctctacctaaggatgggtttccagtacgcaatacaccatttataagccattttttctcggtagcatcataaataaacataggtgacccactgtctccaaatgatcctgctgtcggcataggtccataatcatttcctttacgtacatcgccacttaaactaacatctccatttcctgcaccagtttgcatatgggtattccccgcaataagatatccataagcttcagctacttgagttcctttatcttgttcatttctccaatattgatcaccagaaccaatccgcacacgcatcgggtatttttctttgtctgcataggtctgtcccttcatacttcctgtcatatcaaaaggagaactttcagttacaaatttatgtaaacgaggcatatggtaatccccattataatgatgcttctgatcaggtttataattattacgtttaactatttgataagtaaaacgatgttgatcgggattttgtccttccgcaccaaaatcagcattagtgtatcccccattgtgagcaacacttacaatatattgatcgcctactaatgcagcataaccactacgagcaacagatgcaaaatcaatcatcggagcttttgtcattgatttgccgaccaactccccttttttgttgtaaacctcaatatctttcgcaccgactgcaaacttccctttattctcagcaaaatcacgataatattggtagtcaatcccaaaataagtgtgacctgcccacgcttgcgatactatccctaatgaaatgcaagcggttaaaaaattcagacgaaatacagtttttttcataatgtttatttaattaagtaatttttcgtattaaaaaatacgtggttaaacgactattgaacaataaaagtgcggtgattttctaagggatttcagctaaaaaaacgaactaaaggcacaaaagaaaataaagcagtaaaactatatagtaattaagccaaaatttctaggtttttgcttaatacttagtgggtaatcttatcttgcgatggattaatattatatgtaatttatacagataactaaaattaaaacaatatcactaataaaataaccgcactttatgtgagttttctctgaaagtgcggttattttttctaaggtttttctaaaatcggtttaaggaagcgagcggtgtgggaactttctactttggcaacttgctctggtgtacccgtcgcaataatttgtccgccgccactgcctccctctgggccaagatcgacaatccagtctgcggttttaatcacatcaagattgtgttcaatgacgacgatagtatttccttgatcgcgtaatcgatgcaatacttcaagtaattgcttaatgtcagcgaaatgcaaaccagtcgtcggttcatctagaatatacaaagttttacccgtatcacgtttagaaagttccgttgctagtttcacgcgttgtgcttcgccgcctgaaagtgttgtggaagattgacctaatcgaatataggataatcccacatccatcaaggtttgtaattttcttgcaatcattggaatcgcatcaaaaaactcgcgagcttcttccaccgtcatatctaaaacttgatgaatcgttttgcctttgtaacgaatttctaaggtttcgcgattatagcgtttgcctttacattggtcgcaaggaacataaacatcgggtaaaaaatgcatttcaactttgagtacaccgtcgccctgacaggcttcacagcgtccacctcgtacgttaaaactaaaacgtcctggattataaccacgagcacgtgcctctggcacccctgcaaaaagttcacgaatcggagtaaataaacctgtataagtggctggatttgaacgtggcgtacgtccaattgggctttggttaatatcaataactttatcgaaatgctctaatccctcgatagattgataaggtgcgtaatccgtcttttccgctctatttaacgcattttgcgcaagtggaaataaggtgtcattaataagtgtggattttcccgaaccagatacaccagttacgcaagtaaacaaaccaacgggaatatctaaattcacatttcttaagttattacctgatgcacctttaagtttgagccattttttcttatcaagtgcggtgcgttttttcgggatttcgattttatctgcgcccgataaaaattttcccgtgatggaatttggattgagcataatttcatcggcatttccttgtgcaataacttgtccgccatgcacgccagcaccaggcccaatatcaataatatggtcagctgcacgaatcgcgtcttcatcgtgctccacgacaattaccgtattaccaagattacgcaaatgaattaacgtattaagtaagcgttcattatcacgttggtgcaagccaatagagggttcatctaatacatacattacgccaacaagtcccgcaccaatttgactcgcaaggcgaatacgttgcgcctccccacctgaaagagtttcagcagaacgagaaagagaaagataattcaaaccaacattgactaaaaactgcaaacgctcgcggatttctttaagaattttttccgcaatttgtgctttttgaccagtgagagaaagtgcggtaaaaaattcaagggtttcgccaatgcttttttccgcaattatcggcaaattggtttttccaatatacacattacgtgcttcgggtcgcaaacgagatccgccacagtctatacaaggtcgattactaatatttttcgctaattcttcacgcaccgacattgattccgtttctttatatcggcgagccatattattcaaaataccttcaaaaggatgcttgcgaataaccacatcgccacgatcattcatatattggaattcaatttcctctttgcctgagccatgcataatgatatgttgaatcttctttggcaaagattcatagggcgcttcaacatcaaaatgataatgtttcgccaatgaggtgagcatttgataataatagaaattacgacgatcccaaccttttaccgcaccaccagcaagagaaatagtcggattttgcaccacacgatcttcatcaaaatattgctgcacacccaagccatcacaagttgggcaagcacctgcaggattgttaaaggaaaataaacgaggctctaattctggcacagaataaccacaatgcggacaggcaaaatttgctgaaaaaattaattcttccgctttcggattatccatatctgccacaatcgcagtgccacctgaaagctctaatgcggtttcaaaagattcggctaaacgtgttgctaaatctgaccgcactttaaaacgatcaaccactacttcaatagtatgttttttctgtaagtctaattttggcggatcagataaatcgcaaatttcgccatcaatacgcgcacgaatataaccttgcgcagcaatattttctaaaatcttgagatgttcgccttttcgatttttgacaactggcgcaagtaacatcatcttactgtcttctggcaaacttaatactttatccaccatttgactaattgtttgtgccgttaatggaacattatgatcgggacaacgcggctcccctactcgtgcaaacaataaacgtaaataatcgtaaatttccgtaattgttcccactgtagaacgtggattgtgtgaggtagatttttgttcaatggaaattgcaggggaaagcccttcaatagaatccacatcaggcttttccattaaagacaaaaattgacgcgcatacgccgaaagagattcaacatagcggcgttgcccttccgcataaagtgtatcaaaggctaaagaggattttcccgaacctgaaagcccagtaatcaccacaagtttattgcgtggaatagttaaattaatatttttcagattatgggttctagccccgcgaatatcgatattttccataaaataactcaaaagtatgaaataaatgtaaattttgcgatcattatcgcatattttaatatctgtgcaaatatccagttaaaatatatagatcttttaaaaaatttcaggcaaaataaccgcacttttttagataaaaaatgaggttttttatggctggaattaataaagtcattattgtaggtcatttaggtaatgatcctgaaattcgtactatgccaaacggcgatgccgttgcaaatatcagcgtagcaaccagtgaaagctggaacgaccgtaatactggcgaacgccgtgaagtaacagaatggcaccgcattgtattctatcgtcgtcaagcagagatttgcggcgaatatttacgtaaaggttctcaagtatatgtggagggtcgtttaaaaacgcgtaaatggcaagatcaaaacggtcaagatcgttacgccacagaaattcaaggcgatgtaatgcaaatgcttggtggacgtaatcaaaacgcaagtggttctggtaatgatatgggcggtacgccacaatcttcttaccaagctcgtcaaactaacaatggtaatagttatcaatcatctcgcccagctccacaacaatctgcaccacaggctgaaccaccaatggatggatttgatgacgatattccgttctaaatgacatagattgaaaagtaaatgataaaaatcagagagaagctgaataaaagagagcttctctttttattttactaattaaaaggactaaatctatgattatagatttagtccttaattttatagctttagttttagggaagattaattgctaccatttatcttccatatcacattttattgaagagtaaaactaatttgcacacttaaactcgaagggaatcctgcgggtcttgttccaacagagcgagatacgttaatagcgtctaatgccgccttatctaaactttcatcgcctgaggattttgtaaccttagcaccacttaatgaaccatcagctcctacattaaaagatacactcacttttccttgtttgcgcattatcttcgctcgagttggataacgtttatggctttcaatttcacggcggattgcagaacggtaagccgctatttcactcgtatccgttccacttcctgctacctgtgcattgctattagctgcacttgttgtacttgctttatcatttacgttggcacttgaatcaatattttcatcgccttttggtagctctttattgattggtttcttttgtggtttaacctcttttttaggtttattcttcggcttttcttttggttttggcttttccttttctggttctttgatttttttcggttcaggttttattgttggatcttctacaatttcttgtttttctggttctggctctttttgtacattttctggctcaggctctggctctttttgtacatcttctggctctggagcaggttcttccaacaccatgccctgtaatagttccatagaaatacttgtagatatatcgccttgtgcgctatttgcactatcacttggctcattccaattccataagataaatcctataataataccgtgtgcgatcaaagaaataagcaaacccaatagcgaacgttttgtttgctgcataattattccttacggcgtagttggtacagattgggaaggagtagattcttgagaattttcacccgcactttttcccttatctttcatagaaacaattgccacatttttgatttcatttttagaaagcatatctgtaatcgtcacaaaatcttggaaagaggcttcggcatcaatttttaaagttactttctgatctttattccattgagcaatttctgcctctagagcttcttgagaaataggtttatcattaaaatagagttgtttatccgctgtcactgtcaataatttagctagctcgtcagatttaaatgcgaccgctgtactagcttttggtacatttacttgaattttaccttgagagataaaagatgcagtaataagcaccacagtaagtagcaccaacataatatcaatgaaagggataatgttgatttcatcgaattttttcacgaattattccttatctttttgttcgcttaatactttccattttaaacgattaacttcaactttacgccccaaaccgttataaaacaccatagagggaatagccactagaatacctaatgcagttgcttttaatgctaaagataagtgcaacataattacacttggatcaatgtcgccaccgccgtgaccgatttgatagaaagttaataaaatcccgataactgtaccaagtaatccaacataaggcgcatttgcaccgatggtagaaatcactgtcatattacggtttaaatcaatatctaatgcatgaatagtagaataatgtgccacgcttacctttcttaaaaaaagataacgttcaattaccatcgcaagcataataatgctcatcagtaataataaaccgatgataaaataatcactgtactgttgtaaaaaatcaaaaagttgtaccattttttttccttgttatttgagaaatttttttgagaatataattgagaatgaatttcaatcactcggggaattctagcaaaggctgaataatgcgtaaaccttgaatttaaaaatttctgaattttttaccgcactttatgtggaaaagtgcggttattttttgaaatattatagggaacgaagataatcaatgatcatttgatgatggtcttttatcttaaatttatcaaatacttgcataatagttccgctttcattgattaaaaaactaattcgatgaataccgtcgtaagttctccccataaattttttttcgccccatacgccaaattgctccgcaacttgatgatcaggatcagaaagcaatgtgaaattaagtgcttttttctcaataaattgagctaattttttcggggcatcaggactaataccaagtacaactaagcctagtgcatctaattcagatttactgtcgcgcaatccgcaggcttgtgtggtacagcctggagtgagagcctttggataaaaataaattaaaacttttttaccacgaaaatcacttaaagaaacaaatttttcttgttgatttaataaggtaaaagcaggtgcttgattaccaacagataatggattcataaaaaactcctttaatgaaaaaaaatttgcaaattaacgttattttagcgactataacaagtgaaaccaaataataaaattaaaaaccgacggaggttatatgtcagcgcaaaatcctttattttcgggtagcatagttgcccttgttacgccaatgaatcattatggcgaagtcgatttttcctgtttagaaaaattagtagaacatcacattgaagctggttctaatgcgcttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgttataaaaataaaggggtaagtaattacccctcacttttatgtattatagatcagtaaaatgatcaaaaagtgcggtcagaatttatcaaattttcaatttagttaaggttaatatatgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggatttataaagtactttaattcaatagggcgtgtcatataataatttctctaaaataataaatatttaaacatgagacatagatcatccttttgaaaattactctgatatttatctttaaaacacttgaaaatctaacataagaacactattttgttattaactagaatttaaatcacgcaacaaagaggtaaatgctatgacacttaatattaccagtaaacaaatggacatcactcctgcaattcgtgaacacttggaggaaagacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaggattcttttgaaaactaaatactgtagataaaatctaatctggcagtcttattgtaaaatgatatgtctgtcagattaattttagatgaaacaattaaatcactaaaaattgatgatatttaataaaatattaataatattttattaaatatagattaatttaacctatcgtgcaaggcgatgtaaacttcagtacattcacgcttatccactacaagaacataaacgacaactttatcttcaataacttcataaacttaaacaatgccctacagagcgaaattttattttataaaacacaccaaaaaatccagaaaaccgatcggcaaatacgtatgaatttcctaagcgtttgattaattttttcttaaattgcttttaataaaaatagagactaatgaaagatacagattaaatttatattttttaacgagatagatattatttgacgggattaatggcggtgagaaagggatttgaacccttgatgcagtttcccacatacacgctttccaggcgtgctccttcaaccactcggacatctcaccgtaaaaggttcgcaaactataaagatttactctggtttagtcaagttttttactctaaaaaataaaaatctttaaaagattagttaaaaaataggcaataaaagctattgagctaattcagagttagaagatactaataatttagtaagatgtaaccttgataattattaaaacagttgatttttaataaataccatatattaatttatcttttattctctttcttaatctttttattttaattaaaaaagggattttctcaaaatgatcataccaagatgatggtatatcaataattttatccatttcttttaaaagtaaatttcctatatgacaatttaagtgactgcattttttgtgccaaaatttatttggaccacaataatgagaaataactattggcatttttacgtgtaataaatttttctttttaatcaaacctcgatccgttggtgtaaaattaaatctattattaataaattttacttttcctttacagataccatttagaatatcttgatcttggtatttcataacattattgtatttattcatccaatttattgatttttggaaaatattttcttctttccatttatttaaattaattaataatatacctgcattaaaataagaatatccttctaaaccaatggattttttataagcttcattttttacatcaataaaagtatctcgacatcctgccaaataatagttcattatatctatattccaaagttcttgaagtgaagagtttgttaatgtgtccacatcaatataaatagctttttctatattctttatatatttagttaaatttagtctagcgtaagtcgctaaagatatgtaatctattgtttttggaaagttttgaaaatctgcctcactgacaggcaagaaaaatactttacaaaaatatgcagttgctaaattatttattattgtcttattttcctgatttattttcatatcaagaatataaaaatttattttttcaggtgtatttttaataatgctaaaaatacttacagctaaataaggtgcataatggttgtcagatgaaaatataatatttattgtctgtctgtctgtctgtctgtctgtctgtctgtctgtcataaaattatcttctgattaacgtgtaaattattattttttattaatagattaaatacttttattaactttataatttattttttaaaatattcaatgcctttgctcgatgagaaatttttttcttctcagctgtttctaattcagcaaatgtgcaaccttgttctggactaaagaataaactgtcataaccaaaaccattttcgcctttttcttcaaaaccaatcacgccacaacactcgccttcggctataattggcgatggatctgttggatgctgtaaaaacacgatacagctcacaaatttagcttggcgttgatcttttgcaacatgagcaagctctgccaataatttctcacggtttttagcatcattgccctcttcaccagcataacgagcagaatacagacctggtgcgccattaagtgcggaaaccaccaagcctgaatcatccgcaatagcaggtaaacctgatttttctgatgcataacgtgcttttaataacgcattctcaacgaaagttaagcctgtttcttctgggctttcaatgcctaaatctgtttgcgcaatcacttcaaagccaaaatcagataggacatcagccatttctttcactttgcctttattgcctgtagcaagtacgattttttgtttcataattagtccttttattgatgataagctgccgttaaatcagcccagttttgctcggtaaattgaatattcattcgtccaacttctttttcaaaggaacgttttaaacggttcagattttgtgctttccaaaaatcccctgattttttaccgcacttatcaaaatcaatcaaccaacatttttgctcttgttcagcttgttgaagcaaaatattgtgtgcattcaagtcagtatgacaaatctgtaaatcatgtagttttcgaatcaaacgaccaatttgcctccaagtttcttttggcaatgtttgtgtttgtaaaagtgcggttaaatcctgcgcgttttcgattttctcagtcaaaatatccgcttgatagcaaatacctaacttgcctttttgaatacgtgcggcaatgggtttaggcacaggtaaacccgcttcatacaaacgttgcaacaaatgaaactcagcaaaactacgggtagtttcaagagcagaaaaacgataacgatctttgttcagtttaccccaaagtccaccgcgataataatgacgcaacgcacaatttacgccaaaccaatcttccgtttgcaagaaataagtagtgcctcgaccttttgcacttcctatcactcgttcttgtttttgccaaaattccgcttggaaaaactcggttgcttgctcaaaagtgcggtcaaaattaaagataaaatattggttatcttgttggaattggtgcattagaacgttgttatgaatagaaaatggggtcattctactttaaaataggcacaaattaaatgataaaggaacgtcaatgccattttttaccgaagctccaaaatctctttgtattctccgattgtctgctgtaggcgatgtttgccacgccttagcggtggttcagcacattcaggcatattatccacaaacagaaatgacttggattgtaggcaaaactgaaatgggtttgctttcgggcattcctaatatcacgctcattccttacgataaaaaagcgggatggaaaggcgttttattattctggaaacaattaaaaaataaacaatttgatgcactattaaatatgcaaacagcatttcgtgcatcaatcctttctttaggaattaaagcaaaattcaaaattggatttggagaaaaacgttctcgcgaaggacaatggttatttgtaaatcgtcgtattacagatcctttttcccctcacgtattggatggatttatggctttcgctgaatatatcggcgtaccaaaatcagaaccgaaatgggaattagctatctcacaagatgatgataaatttgccgatcaatttattgatttttctcgtaaaaatttattgatttccccttgttctagcaaagcagaaaaagattggctaattgaacgttatgcagaaattgccaatattgcccatcagcataatatcaatgtgattttctgcagttcgccagcgaaacgtgaattagaaatagtcgaaaaaattaccgcactttgccatttcacgccaaccaatattgcaggaaaaacaaacctaaaacagcttaccgctttaatttctaaggtcgatctggtactttcgccagattctggccctgcccatattgcgacaacacaaggtacacccgttattggcttgtatgcctatcacaatcctttgcgtactgcaccttataataatttagataacgtggtatcagtatatgaagaaaatgcccaaaaagaatttggcaaaccgtcttctgaactaccttgggcaaccaaactaaaagggaaaaatttgatggcagagattcaagtcgaacccgtcattgaacaaatgaaaaaattgggattattttgaacaaataatctgtatctcaaaacttagatggttttaatatagccaacttgaaagttgtttttggaaagtaagaactttagttttttttaagttaaaaatcaataacttgttgtcaaaataattatatttagtcataaaaatctataccttaatctcttgcttatttagtccaatttttgcaggtacagattgaaatccaaaattagtttgaattttacgcaattaaatgcaaatgattataaataaacctattgattattataatcatcattattatcatcgccattctcctatttttaattattacaataaggaaaacagatgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttctaaatttactttggaaaaacgccctaaagctgttttccctcaatttttgtaattttatcaattaataggacataaggaatgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttctaaggaggtatgctatgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcaattaacactggtggaagagcagcggaagaagttctaattaatggggcgttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaataactattcagaacacaaggtaaaagcataaagccaatctgacagacatcaattaaattgcatgcctgtcagatttattaatagccactgttgctatattattttaaacatccacgtataaccaatacgccaacatttcgagcttgcgcgacggcttttggtttactcagtttaatttttaatccttgaagttgataacgtgactcaagcaaatccgccacttcataagccactcgctcaatcaacaagaaagatttactttccacataatcaataatcgcttggctcacttcagcataattcaaacaatatacaacatcatccgtttctgccgcttgtttacaatcccacgccatttccaaatcaaacacaagtttttgttttatttgctgttcccaatcatatacaccgatttgtgcaaaaacagtcaattcctcaataaaaacacgatccataagatttcctctaaaattattgtaggcgtatgctatcaattttgggtagaataacgaacagtttttcttgctggagtgcaaaatgagccttttcgcccttttttatatgctttttgcctatcttttaggctcaatttccagtgcgattttaatttgtcgcattgcaggcttgcctgatcctcgtcaaaatggctcacacaaccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataaaaattttaccgcacttttctaaatttccactggagtttcctgtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttgtccagatccccgaattatgcaaaatttagcgcaaatgcttgctcgtgcgctttatttccataaaaatttacgtcagaaagaacagattttattaatggaagaacgctcaattattgcgcgagagttgcacgattctttggctcaagtcttatcatttttacaaattcaacttactttgctcaaacataacctgaagaaagaagacgaacaatcaaaagaaaagagtttggcaattattgccaattttgaacaagccctttctggtggttatgcacagttacgtgagcttttagccactttccgtttaactatacaagaagcgaatttacagcttgcactaaaacaagtgattgattcattacgctcacaaacaacaatgcaaatgaatgtgaattgtcaattaccatcgcaaagtttgaaccctcaacagctggttcacgttctgcaaattgtacgtgaagccaccaccaatgcgatcaaacattctcaaggcacggtaattgaaattagcgcaagaattaatgcggaaggcgagtatgaaattttagttgaagatgatggggttggcattccaaaccttgaggagcctgaagggcattacggcttgaatattatggcggaacgttgccgtcagcttaatgcacaattgcatattcatcgccgagaacaaggcggcacacaagtcaaaattaccttgccacatacattatattaggacatcaaaatgcaaaatttacaaccttttcacactttccacattcagtctaatgctcgtgaaattattgaagcacatagtatcgaacagctacaacaagtgtgggcgaattctaaatcagaaaatttacccgtactttttttaggtcaaggcagtaatgttctgtttctggatgattttaatggcgtggtggttttaaatcgtttaatggggattacgcacgaacaagatgcaaattttcactatcttcacgtcaatggcggcgaaaattggcataaattggtggaatggtctattaataatggtatttatggcttagaaaatctggctttaattcctggctgtgcaggatctgcgcctattcaaaatatcggtgcttatggcgttgaatttaaagatgtgtgcgattatgtggatgtacttaatttaaacacgaatgaaacctttagactcgacacagaacaatgtgaatttggttatcgtgaaagtacttttaaacatcgttatcagcaaggttacgtgattacagcggttggattaaagcttaaaaaagattggcagcctattctaaaatatggttcgcttgtagacttcgatccaaaaactatcacggctaaacaaatttttgatgaagtctgtcatatccgtcaaagtaaattacctgatccaaatgaaacgggtaatgcagggagtttctttaaaaatccagttgtcagttcagaacattttgaggaaatcaaaaaacatcacaaaaatctaccgcactttccacaagcagatggctcagtgaaattagcggcaggctggctgattgatcaatgtaatcttaaaggttttcaaataggaggggctgcggttcataaaaaacaagcattagtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacgtaattttataataattgaactttcaattgataaaatctgtcttattgacaaattagttcaataagatagcttattgtgctataactaagtacattgattggcaaaagccaaaataaagaagggaaacgatggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccatgttgcacgtggctattctggctatggtttgccacaagctgacttaatccaagagggcaatatcggtttaatgaaagcggtcaaacgttttaaccctgaagttggtgtacgcttggtgtcattcgccgtgcattggattaaagctgagatccacgaatatgctcttcgtaactggcgtttcgtaaaagtcgcaaccacgaaagctcaccgtaaattatttttcaacctacgtaaaactacacaacgttttaggttggttcaatgaaaatgaagttgatatggtcgcaaatgaattgggtgtttccaaagaagatgtgatcgaaatggagtctcgaatgagcggtgcggatgtcggttttgatttacctactgatgatgcagaaacagagacctattctccagccctttatttggaagataaaagttctaatttcgcagcagagcttgaaaatgaaaactttgaaagccaagcaaccgagcaattaggtgcagcgttacaaagtctagatgcacgtagtcaggatattatcaaagctcgttggttagatgataacaaagccacattgcacgatttggcagcaaaatataatgtctctgcggaacgtattcgtcaattagaaactaatgcactgaaaaaattaaaaagtgcggtgaatttttaaataatttagaaaaagaaaacctgctgattagcaggttttttatttctcatttaaccgtaatttcaaatcttcagcagtttggcaggtcttaatcttatcaaacacttggttcgcctcgtcatattccttattcaaataacgtaaccactgtttaattcgtgccacatggtaaaaaccgctgtcatattcattttcgacattagcatatttttgcaagattttttgaatctcataccaaggcattctggatgctgccctagcaactgcactcgcacaggcgtaccagaagaagtaaagccctgattttttaattcagggcataaacgataaaatactttttcagggagaaattgatcaactacgcgaacaaattctgttatacataaatcgtagtcattcacttcggtgagaagttggcgtacaaagggatctagaaccccttgcataggcgcaagaataacacgcactatttccagccttttgctttacaaattaaatcgtaagcggcttgaatctgttgagttttttcttttgccatttccatcatttctggcggtaaacctttcgccacaagtttatctggatgatgttcattcattaaacgacgataagcacgcttaaccgtgctttgctcgtcggactcagtcacacccaatactttataggcatcatttaaagttgggccagaagcatgttggtaaccaccactattttgttgttgatattggtagccaccttgatatgcaccttgttgatattgctgataaaaaccgccttgagtaaaagctcgagcagccatttccatcgcaatcatttgttcaaattgcatacgagaaagcccaagttcttcagcgatcacataaagcacttctttctcattttcgtgaagttctgaatcggcaaaagccgcttgaacttgcacttgtaagaacattcgcaataaatcagcacgttgcccacaaccaatgcgaaattcacggataacttgacgaatcgggaaatcagattctttaccacgacgaaacgcatcttgcgctaatttacgcccagcatcatccagtttaagctgaatcattaattgattagctaattgaatatcttcttctgttacacgccctttcgatttacttaaatgtcctaacaccgcaaaggtggtttgcataaacaagtcttgacgtgttgttttctttttaaagaaactagaacttaccgagccaagctcatacaattttttatctgcaatagagcctaaaatgagaccagcaatcgcaccaaaaaatccaccaactttccaacctaaaaatacgcctataattttcccaataaatcccattctttcccctgttaagtcaaagtgcggttatttttataatgttatttataatgatgataaaaatttatttctcaagttttatacgccaaattcggcacgataagcacgcatttctggcaaatggctactgtatcgaggatcttgttcgataaattgcatcaaatcatctaaatcaatgattgatagcacttggcattgataatcacgttctacttcttgaattgcagaaagctcgccttttcctcgttccttacggtttagagcgatcaataccgccgcaagctctgccttatttgcactgattaattccatagattcacgaattgcagtgccagccgtaatcacgtcatccacaagcaaaatttttccttgcaatgggctaccaattaaattgccgccctctccgtgatctttcacttctttgcgattaaaacacacgggtttatcaataccataacgattaaataacgccaccgaaactgaagtgccaattggaatgcctttgtaagcagggccaaaaaccacatcaaaatctaccgcacttgcttgaattgccgcagcatagaactcgcctaaacgcgctaaatctgcccccgtattgaacaaacctgcattaaagaaatacggacttttacgccccgatttcaaagtaaactcgccgaatttcaatacatttcggcttaaagcaaattcgataaaatcgcgtttatattgttccattttttaactcctataaactgtgtttataagcctaacgcttcgcgttgagcgataaaaatttgattacagccttgtttcgctaaatctaataatgttaataattcttcatggctaaatggctcgccttctgcagtgccttgcacctcaatcattcgaccatcttccatcatcacaacattcatatcggtttccgctgcagaatcttccacatattccaaatcacaaacagcttgaccatcaacaatccctacagaaattgccgaaactagccctttaattggattagtttttaacgtgccattctcaattaaaccattgatcgcatcacataatgcgactgcagcaccagtaatggatgcagttcgtgtgccgccatccgcttgaataacatcacaatctaaagtaatcgcacgttcacccagtgctttaagatccaccatggcgcgcaaagagcgggcaattaagcgttgaatttccattgtgcgtccaccttgtttacctttagccgcctcacgttgcatacgactatgtgttgaacgtggcaacattccatattcagccgttacccaaccttgcccttgtccttttaagaaacgtggcacagcatcttccactgttgcagtacaaagcactttggtgtccccaaattcaacaagcacagaaccttcagcatgcttggtgtagttacgggtaattttaatttggcggggttgattattttctcgattatttggacgcataattattccttgatatgatttcgaacgatgtaataaaaaagcgcactattctagcacgctttagtttttatttttgttaaaattcgctaagatattgattattgataataaaaaagcaaggtaaataaccttgctttattaatttggtggagataatcgggatcgaaccgacgacctcttgaatgccattcaagcgctctcccaactgagctatatccccataaaagacagcgacatgataaaatttgactatgtggctgtcaatacgattttattatgcgtttgttatccgattaaatattaagcgttttgtgcatgaataaaatcaatagcgcgctgaatacgcacaagtacgcgatctctgccgataccgactagggtaacatccattgatggcgattgaccagaacctgtcacagcgacacgtaatggcatgccaactttacccatgcccacttctagttcagcagctgtttgctcaatggcttcgtgaatagaatgtaaattccagctagaaagtgcggttaatttttctttcacttttgcaagcgcttcagcagcattgcctttgaaatgttttttcgctgcggcttcatcaaaggtttcaaactcttcaaagaagtagcggcttgaacttgccatttcttttaaggttttgcaacgttccgcaagcatggagacaatatcagttaatgcaggaccattgcttgtatcaatgctttgatctttgtaatgccattcaagatgtttagccacatattctggcggtaattcgcggatataatgttgattcaaccattgtaatttttcggtattaaatgcgctagctgatttgctaacgtgatctaattcgaaatagttgatcatttcttcgcgactaaaaatttcttggtcgccatgtccccagcctaaacgaacaagatagttaattaaagcttcgggtaagtaaccatcatcacgatattgcattacgctcactgcgccatgtcgtttagagagtttttgaccatcatcgccattaatcatagaaacgtgtgcataggttggaattggggcaccaatcgcttttaaaatgttaatttgacgaggcgtgttgttgatatgatcttcgccacgtacaacatgtgtgatacccatgtcccagtcatctacaactacacagaagttataagttggagaaccgtctgtgcggcgaataataagatcatcaagctcactgttgctgatttcaatacggccacgtacggcatcatcaaatactaccgagccttcagttggatttttaaaacgtacaacatggggttcatcaggtgaatggttgtgatcgtgtaagcagtgacggtcataacgtggtttttctttattttgttcttgagtatgacgaagttcttctaagtgttctttagtacaataacaacgatatgctaagccttgttcaatcatttcatcgatcacttggttataacgatcaaagcgtttagtttggtaataagggccatgctcccacggaagatttaaccattccatgccttcaataatggcagccgttgcttctggtgttgaacgctctaaatcagtgtcttcaattcgtaatacaaattcgccgttattatgttttgcgtataaccaagaataaagtgcggtacgtgcgccacctacatgtaaataacctgtagggctaggagcaaaacgagtacgcacttttacatttggatctaaattaaaaggagcatctagtttcatctttataacctatcttcaataaaatattagtcgttattctactacgacttgtttgacttctaaataaaaaagcggattttatgcttatttttacgacaattaaacaaaatttaataaaaaggtattgactgaaaatgcattctccctataatgccaacccacaacattaagggcgattagctcagttgggagagcacctcccttacaaggagggggtcactggttcgagaccggtatcgcccaccacttctctaaaaagtgttcttaatgttactaagtttgaccaagcgggcgattagctcagttgggagagcacctcccttacaaggagggggtcactggttcgagaccggtatcgcccaccacttttctaaagtgtcctttccgctcaaactttccctttatatttaaacgctttctagtgggcgattagctcagttgggagagcacctcccttacaaggagggggtcactggttcgagaccggtatcgcccaccacttaaaagtgtttaaataaaccgaaaatttaaggttttgccttaatattatcgggcgattagctcagttgggagagcacctcccttacaaggagggggtcactggttcgagaccggtatcgcccaccactttattttcaaattatccaaataattttcttttcccgttcaatccattacgtttacgtgataaagtgcgcaggcattgtcatatctaattttaaactgtttatatatcatagggaaaatttatgatcgcttatattttcttagctttattcacgattgcggcagtgatttttattgtaaactcccattatcgttggacttatttctttgctattacgctttttacttttttatttggcggcatgcttatggtttccagccaatggcaacgtgctttaaatttttcatcagtgctttttgtagtgctgatgttatttcatcgtttaaaaattcattattacaaacagcctttgttaatttcagatttctttcttgtggtggattggcgaaattgggaaaccttaattcattataaaggtgcgttgtttggcgttattgggctactggcgttattaggttatgcgatttttggttttaatgatgtcgagtctttaggggtattgggtaacagcattggtgctttattgtttatcgttagctttagcttgatgtggcattattctaaaaatccaagtgcggtgcaagtttggttagattctttgcctgatgatggtcgtgatgtgtttttaaatttaccaatgtcttgtcgcggtatttttttcaaagtgccaaattttgatggcaatagccaaaattttattgaaaaaatgaccgcactttcatctgatacaaacaacctatctgaaacaaaacccgatattgttgtaacattaatggaatccacgctgaaccctcatcaatttgcttttagtcagcaatctattccaccactttccatgtttgagtctcaaagtgatacagtatttgcttcgccgttgcgtgtacatacttttgctggtgcaacgtggaaatcagaatttgcttttttagccggtgtaccttcaaccgattttggtgcgttagcaagtggcgttttttattctgttgtaccgcacttgcaatcaggtttagtgaaaaatctaaaagcacaaggatatttttgtgttgctttgtcgccttttacaaaaggtaattacaatgcgaaatccgcttatgatcatttcggttttgatttaatgttacagccgcaagatcttggttatcctgcgcctattagtaaaaatctttgggatattagtagtgaagaaatgatgaagtacacccgaatgattttagaaaagcagcatcctgcactagaaaatgtagatcagccaatgtttgtttatgtattgactatgcgagaacatggcccatacgaattgggcatggaaaatatatttaatcttcaaatgcctaatttaggggctaaaagtatttctgcattgaatgactatactcaacgtattgttgcattaaatgatgcgattgaaggaatgaataactatttacaagaacgtaaaaagccttttgtgctaggttatttcggtgatcaccaagtggcatttgataatgctatccctccgaagaaaggggattatgcacagcccgattatgtgacgcaatttgttgtaagaagtaattatgcaagtcaatttaagcaagaacaaaagtttttagatcttgcttttgctggaggcgtcttgatgaatgtagctggattatcagcagaagatgaatttatgaaagcgaatatggcaatgtgtaaactaagtcacggaaaattagaagattcttctgatattcagctactcaatgattatcgccattatttatatcaaacattggcgattgccagataattttcttagatcgagcattattgctcgatctgctcgccaatttcatctaaggttgaagctaattgtgcaccaactaataccacaagccaacttatttgaatccacaataacataattggtaaagttgccattgcaccgtaaattaattgataagagggaaaagtgacgacataccaagtaaatgcttgtttaccaagagtgaaaaaaatcgcggcaagaaatgcaccgtaagctgaatgcttaattttcacttttttattcggtacaaccgtataaataagcgtaaaaataaaccaagtaaataaaaaaggcacaaaactgagcaattttaagcctaatgataaatgttccgattgctcaaacattattttaatatacgaactaatcccaatactcacgccaataataagtgggccaagtgtcaaaatcatccaataaatcgcaaaagaagaaagcggagagcgagattgactattgtgccaaatactatttagtgttcggtcgatgttattaattagcatcaaggcaacggcaattaaactcacaattcccaccgcactcattttctttgagtttgatacaaattgatcgatatattcgcccaccatatcactcgctgatggtgcaaaattagtaaaaatcatttcttttaattctcccgtcacttcattgaatacaggaaaagcagagaaaatagaaaaaataaccataactaaaggaactattgctaacattgtgctataagtcaatgcaccagcgacttgattaagtttattttctgaaaaacgtttccaaaataataatccaaaattttttaatgaaatcatagaaatcccccacaacaatgtttaaattttttaccataaccacatacacaaggttgtttcattgtcggtaatgatacggtcggatcaacaaaataccaacggttttcaatttttacaaaaattgaccgttcttgatgggctagttctccctcttcgccttgaaaaatcgccttaaattctaccgcactttgagtttttgtaaggctttccgtttttagaatttctaatcctagccacgtagtgttgtccgcccattcttgcaataacctaggctttaataaagtttgttggcttggcgcagttgttacaacaatatagggaatattttttaacacataagccgtataacgtgaacgcataagttgctctgccgtttcgggaaatgcttgtctcaaatgaaatttgccacaacaatctgcgtaatgatgactagattgacatggacaattttctaaagaaagtgcggttgaaatttctgacatatttatccctgttgtttgaatttcgatatttgcgatcgaattgagcgtttaaaggcttcagctaatacttcaatctctaatgctgcatctaattcagcttcattttcgggcgcagataacaagcgatttaaatgacgaattgttatttgcggataaggacgggcgagtaattttagttcatccttttgcttaattgttcctgtttcaataatacgaacataccatccactaagcccagtttgataaacaatatcgcgagtatcttcgttttccgtgttttttgataaacgctcacaaggtttacgtggttgagatacttctaaaatggttgagccgatttgataacgatcgccaatacatacattgtcttcattcaagcctgacacgacaaaattttctccgtatatcgcagtatccatataagaaaaatctttatttaataaagtatttaattcattaaaagaatctgccgacataaaaaagagagctttatctacaccaccgtgatgtttttttaaaccaacatcgtttccttccgcaccaagagaatgaatttttaccgatggcacaacttttttacgaatcgcgctttcatactggcttccatcggaaaaggttagggtttcaacttgtcccacttttataactaaaatttttgcattcattttatttttcgcttgttctagaaaaaatttacgtggaattataaccgaaaacgtttaactttttgaccgcacttctttttttacttattattcgttatcagaaaaacaaaaaagaaataataaaaatgtttgaaagagaaaaaaattttctaaaaatattttatttcttttcttgaaaataagatttttcctaagggcgaaatcatcacgttcaatgataataaggagatttattatgtcagacgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccatcaacatcaatttgtgtggaagaacttgctcaacttggtgttcgcactttcttacgtattggcacaacgggggcaattcaaccgcacattaatgtaggcgatgttcttatcacaactgctgctgttcgcttagatggtgcaagctgtcattttgtaccattagaatatccagctgtggcaaactttgaatgtacaaccgcactttataatgcagcgaaagcaaaaggtattgagccttatgtaggtgtaaccgtatcatctgatacattctatccaggtcaagaacgttacgatacttatagtggtaaagtatatcgtgattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagcggtgtctgttgtgatcgcagctgcacaagcgttgttaagttaaattaatatttatttgaaacaataaaactttattttattctgcaccttaattagatttattttctaacgaagtaaggtgcagatttttttattaataaactgcgatcttctgatcaatttaatcaaagtagtctatttacttgttggcattgaaacctaaacttgatataagttctaaataaactacttctaaaggctaaataacctaaaatatttacgactaaaattagatttctgttaaatctacatttttagtctcttttgaggctaataatgccaagaaagtcattaatgcattgattgctaaataaattcctacgcccattacaccgaatgacgcgttaatttttaaagaaatcattgctgcaattgttgcaccaataattgatgctaaattatacgcaagagaggcacctgaataacggacttctgttgggaataattctggtaatagcgcagccattggaccaaatgtcattcccataatcgccataccaatcactaaaaatgcaaatacgctaactggagtgccattttctaagaataacggcattgctaaaccaagcacgccgatagcaatagtcacccaaatcaaccatttacgacgaccgattttatctgcataaaaaccggaaatactgataaaaataccaaatacaatggcactaattaataacaagccagtaaatgtatttgctgggattcctaaaccaagcgcataacctgcttcagaaagctttggcacggttcgagaatatgcctgtgcaaaagccgtcataatgtaaaacaaagaataagttgccaccataataaatgtaccaatgatcattggttttaagtgtttggtaaacacaacactcactggtgcattcaattttttgcctttttgctctgcttccacaaatacgtggctttcgtgcaaagttaagcgaacatataaaccaactgcaactaataaaatggaagatacaaatggaatacgccacgcccattcaacaagtgcattatgaccaagtaaatagctagctaagaagaacgttccattagcgacaaataaaccaattggtgcgcctaattgaggaaaagtaccgtaccaagctcgttttccttctggtgcattttctgttgcgactaacgctgcacctccccattctccaccaagtccaattccttgacctacgcgacatacacaaagcaaaatcggcgcccagataccaatttgagcataattaggaagtaaaccaattactaccgttgaaccacccattaaaacaagagaggcaaccaaggtttttttacgaccaattttatcgccaaagtgaccgaataatgccgaaccaataggacgcgcaaaaaatgctaaagcaagcgtagaaagagaaagtaaatcattagaaagcggatcatcgctatgaaagaattgcgtattgaaaactaatacagcggcagccgcatagatataataatcaaaaaattcgattgccgtaccgaccatcgaggctaacgccactttcatcggattattacgaagttgtgtagacattgtgtttccttagaagtttattataaagagaaaggattgaatcctagcattttaactaaggtctaacaatttttaatatgcaattttctatttttttagagaaatattttgagttttctaaatgtgagttatgtccagcgcagggaattgtcactaaatcaatttgattttctttggctaatacttggaacttatgatctctttcgccacaaaaataaaaaaatggcaaagaacttaaccgcactttttcactaaaatcaggttgtttggatagacttgtcgccagcagcattttgccaatattttccccacaatttgattttcgtttttcaaccaactgtaatctttcttctgcagtcaaatgagaaaacacaggttgttgataccaatcattcaacactttttctggtggttcttgtataaaacgttgcgcccaagcaaaatcctgctgaaaacgagcctgcttttcttcgtcagtttttaaacctagattcgctccttctaaaataacgccttgcaaattagatcgttccacctgagctttcagcgcataatacaaagcgatccttccacctagagaatacccaacaagaaaatagggttcatttttcaccgcacttttaatttgcttagccaaatactcagccgtttcttcaaaatttgtgacttcaatatctctagcttgcccgtgaaaaggcaaatctagcgcaatacaattaaagtgcggtagattttcaatgactttttgccagtcattttttgtaccaagaagtccgtgaagaaaaatgatgtttatcattgaagggattattgatagaaataataaaatatggcggactaaagcccgcctacagaatatttaagcaccaatcacggcgtgactaatttgatcgattaagcgtttatacaaactactaccatcactcggattcgttttaatttcaattaacgttgccttgcgacgactataagcctgtttaacaacggaattgagatccgcccaagtataaggatgagcgtatttgagatcgaacattgccgcgatttgagaaaaatcgccattatgcggtaatcgatagaactgatctttgacttgttcatccacaggtaacatatcaaaaatcgcaccaccattattattgatcacaaagattagcgttggttgcgtaacatttttgaataatgcgaaagaatttagatcatataaagtggacgtatcgccaatcaccgcaacaacaggtttatttgaaccaatacctattccagcagcagtagccaacaaaccatcaattccactcgcaccacgattggtataaacgggataactttcgggtaattgcgttagcgcatcaaccagacgaacaagtaaactattacctaaaaataaaacaccgttataaggtaaaagtgttggtaaacgtaatgctagcgaggcttccgttaaatttccgcccacttgctgttcaataaaggtcgcacagaacttagataaagctaacggctcaagcaaccaaggcttttggcgtaaaggtggatgcgcacgtaaccaatgatgcgctttagcattgaatcttgtcaatgaatgatggtaaggatctagtgctttaccgctttgttcaactagccaaaattcccctttaaacgcctgcaagaattgattaatgcgtttactaataaaacgcgcgccaaattgaatcacaatatcagcttgtagaagtttttcacgaacagtttggtttgctagccaaatatcttcataaggcgtcgttggaacaacaccagattgaatatccgtcagtaacacccagcccatagcacttgcccaagaattaatgcccatcgcttgttctgcaggtaattgaccaaccacaacgacaccacgtttggtacgccaatgatcccaattttcatgcattaatacttcgttttgttggacttctacatttatccaagacttgttttgaattaaccagcgttgtaacggctgtagccaactatgggaatttacttcctcatcagttgcatcataaagtggctcggtaaatggcacattaatatgaacaacgccaccttgttgtttttgttggaaagctgcctgttcaagtagagaaatcaaccactgcgcagaataatcagcgttcggtttaggtaaattaacatttgcaactggatactgaccaaacatattttgttgcaaaatagcttgatttgcaccgcactcccaaagttctggtggacgatcagcagttaaaacaaataaattcacaccggtttggcgcgcttcaataattgctggataaaggtttgcagtcgccgtgcctgatgtcacaataatggcaacaggtgattgagttgccttagcaataccaagtgcaaaaaaacctaaaccgcgttcatcaaaatgcgtatgacaagtgactgaacctgcattttgcaaacgtacggcttctagagttaaaggtgtcgaacgcgaacctggcgcgatacaaacgtgagaaacgccttggcgcaccaaggtttctaaaatcactttcgaccaacaacgattaaacacgcttaccgacattttttttctccgttatcatttttcttctgcaaacaaggaaattaaccctgctgctttacgttcaatttctttccattcttccaatggctgcgagcctgccacaatgcccgcgccagcaaatacacgaatacgatgaccttcaataaaagcagaacgaatcgccacacaaaactctgaacatacatcgctcatcacgcccaatgttcccgcataccagcctcgatcaaaggtttcgatttctgacaaaatcattttggcttgttgctgtggcaaaccagatactgcagctgtaggatgaatcgcttttaatatatttacatctgcataatgtgcggtcaaatttgcgcgaattttacgaatcaaatgttgtactttacgtaacggtttcaattccacattgcttacatcaaaactttctacttgcttacgtaaattctgcgaaatatcttctacgaccaaccaattttcttttaaatttttctcatcatttaacaaccaattggcttgagattgcgtttcttcctcactttcagaaaccgatgctgtccccgccaaagcttcggttagcaacaaattatactcacgagcaaataggcgttctggcgtagaaccaacaaaaaccgaatgagaattttcagcccataaaaaatgataacaaccttgattttgtttttcgctttctgctaaaaaatcgtacgcattaatcgcttgctttaaatgaaaagtggtttcattggctaacacaatttttgtcagctctccacttttaatttccaccaaagcctgatttacccaatcacaccaagttctttcattagctcgaggctctgtatgcaaaggaatttgttttggtaacgcagaaagtgcggtgagattttcaaaagttttgaggtgggctaaagtatcattcgcactttgctcatctttcacaaaaaaggataccaacgtgcctttattatcctgttcaacaagcattttaggtaatacaaattgtgcagtgccttgaaattgcaaaccgcctaccagtggaaaaccactttcttcaataaactcttgcgctaaatttaactgtgaaaatgactgcactgccccaagcgcagccagtgctttttcttcatcacgaaaatgtaaataaaattgaggatacgcagattgacctttcagccacgccaacaaatcgaccttgtccagtttcacctgaaaacggacaagttcattcgttgattgctgtaaatatgcgtgaatttgcgattttaactcccctattgcctgcgctaaataactcattagattttgttttaaatacacaaaaaattagccgtattctaccgcagattgttaatgacaaaaaatttttttacaaaatcttttcaatattaaaaattcagcgtaaattaaccgcacttttctcgaaaaatttattagaaacaaaaggatttcactatgcgattattcccaaaatccgacaaattagaacacgtatgttatgacattcgcgggcctgtgcataaagaagcactacgcttagaagaagaaggcaataaaattttaaaacttaatatcggcaacccagcccctttcggttttgaagcaccagatgaaattttagtggatgtgctacgtaatttgccatcagctcaaggctactgtgattcaaaagggttatattctgctcgtaaagccattgttcaatattaccaatcaaaagggattctcggcgcgaccgtcaatgatgtgtatattggtaacggcgtatctgagcttatcacaatggctatgcaagcactgctcaatgatggcgatgaagtactcgtgccgatgcctgattatccgctttggactgctgcggtaaccctttctggcggtaaagcagtgcattatctctgtgatgaagaagcaaattggtttcccgctattgatgatattaaagcaaaggtgaatgcgaaaactaaagcgattgttatcatcaacccgaacaacccaacgggtgctgtgtatagcaaagaattattacaagaaatagtggaaatcgcgcgtcaaaataatttgattatcttcgcagacgaaatctacgacaaaattttatatgatggcgcggtgcatcatcacattgccgcactagctcctgatttattaaccgttacgctgaatgggttatcaaaagcttatcgagttgcaggcttccgccaaggctggatgattttaaacggtccaaaacataatgcgaaaggttatattgaaggcttggatatgctggcatcaatgcgtttatgtgccaacgtaccaatgcaacatgcaattcaaaccgcacttggtggctatcaaagtattaatgaatttattttaccgggcggtcgattacttgagcaacgaaacaaagcctatgatctcatcactcaaatacccggcattacttgcgtgaaaccaatgggggcgatgtatatgttcccgaaaattgatgtgaaaaaattcaatattcgcagtgatgaaaaaatggtgctggatttactccgccaagaaaaagtgctacttgtgcacggtaaaggatttaattggcattcgccagatcacttccgtgttgttactcttccttatgtaaatcaacttgaggaagccattacaaaattagcaagatttttgtctgattaccgtcaataatgaatgctttgacaacattacaaaggggactgaatgtcccctttttatcgatataaatatattgcactttccttttgcactactataatagtgcaaatttattttagaggcattttatgacacaacaaagatccccttctctcttaggcggtgcgatgatcatcgctggtacagctattggtgcaggcatgctggctaacccaacttcaacggctggtgtatggtttattggttcgattctcgctttaatttatacttggttttgtatgaccacatcaggattaatgatcctagaagctaatctgcattatccaacaggttcaagttttgacaccatcgttaaagatttattaggaaaaagttggaatattatcaacggcctttctgttgctttcgtcttatatgttttgacttatgcctacataacctcaggcggaggcattacacaaaatctgctcagccaagcattcagttctgctgaaagtgcggtagatattggaagaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaagcatatttaccttatttattgaccgcacttccagtttgtctcgtgtcgtttggtttccacggaaatgtccctagtctcgtcaaatattacgatcgtgatggtcgtcgcgtgatgaaatcgatctttattggtacgggcttagcattagtgatttacatcttatggcagctcgctgtacaaggtaatttaccacgcactgaatttgcaccagtcattgaaaaaggcggcgatgtttctgcattattagaggctttacataaatatattgaagtggaatacctttccatcgcattaaatttctttgcttatatggcaatttctacttcattcttaggcgtcactttagggttatttgattatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaatgctatttggcatattaaatattgtggcgcaaattggggcaaacttaggttggtttgcaagttttactgggtaagttttaaaaaataaatttaaattattaaatagcgatctgcactttaactgtgggttatgtagtccaactaattcgtgcagatcagcccctcaattattttactttttattagttacaaacaattttaactgcaagtccgccttgagatgtttcgcgatacttggcgttcatatctttacctgtttcgtacattgtttcaatcactttatctaagcttactcttggattggtggtgcggcgtaaagccatacgcgatgcattgatcgctttaactgaagcaattgcattgcgttcgatacaaggtacttgaacttgaccgccgacagggtcgcaagttaatcctaaattatgctccattgcaatttcagctgcgatgcatacttgtagtggattgccacccaaaatttcagctagtcccgcagcagccattgaacaggctacacccacttcgccttgacaacccacttctgcaccagaaatagaagcgttcatcttataaagtgaaccaatcatccctgcggctaataaatagcgttcaatgatttcaggtgttaatggcgagatgaatttttcatagtaagctaataccgctggaataatcccgcacgcaccgttagttggtgccgtaaccacgcgcccgcccgctgcattttcttcattgacagcaagcgcaaacatattgacccagtcgattacgcgcattggatcgttagataaattcgtatttgcttgcaacgcacgataaagtgaagctgcacgacgtggtactcttaatgggccgggtaaaataccctctgtgtgaataccgtgttcaatacaagcctgcatcgttttccagacattctctagatgagcactaacagcctctttgccattcaatgcgatttcattttccaacatcacagtggaaagcattaagccgttatcactacaatgtttcaaaatatcttcggcatttttgtaaggataaggcacttggactgtgtttttttcttctttgccaaaatgggcttcatcgacaataaaaccacccccaatcgaataataggtttggcgataaagctctgtgcgattttcatcaagagcggtaattgtcatgccattttcgtgcaattttaaaaaagtgcggtggaaaatgagattattttcaaaatcaaattttactatcttttgaccgacattaatgggtaaaagcgcagtttgtttcactttctcgatgaaacctgaaatcatatcgatgtccacattatgtggtaaataacccgctaatcccataatgatggcgatatctgtactgtgacctctccctgtcatcgaaagagagccatacacatccacatgaatttcagctgtttgttcaaactgatttcgtttaattaagtcgtctataaattgtttacccgctttcatcggaccgaccgtgtgggaactggatggtccaattcccactttaaacatatcaaatacgctaatcataaatttctcaaaattcgttaaaaattaaaagcgattataataatccataaacaactgcagaaatagcaattagtcccataattgttacaaatacattactgaaacgtccgctgtagcgtttcattgctgggattttgcgaatcgcatacattggcataatgaataaaatcatcgcaatgattgggccgccaagagattcaattaagcctaagatacttggattaataatcgcaacgccccataaggttaataagaagaaaagtgcggtcgcataattgagttttttacgatttacagattcgcctttcattttcaaatataagccttctaatccttcacgtgcccccatatagtgaccgaagaatgaacttgtaatcgctaagaatgcaacaagcgggccaaaataagagatatatggattatcaaatttatttgctaagaaagacaagatactaatattctgttcttttgctgccactaattcttcaggtgttagtgttaatacacagctaaatacgaagaacattacgaagaataataaaatcgttgaagcgcctttttctgtatggctgatatggcgttctgcaccctcaaacgttttgtattcacggaattgtgagcaagtgaacgatgaagtcgctggcgaatggttaaatgaaaatactaatacgggaatggttagccataaagtggttaagaaaccacctgttgttggaaattcatataatacggcactattccattcaggaattaagtaaatagaaagaacaaataaaattaagactaacggataaacaagccattctgtgatttttaacatcactttttcattaaataacatcacggaaatcaataccgcaattaatacaaaagagagaatgactcgatttggtgatgccataccaagttgatttacaatgaaagaatctacggtgttcgtgataccgttaccgtaaatcaacagaatagggaaaatcgcgaaaaaataaagtaaggtaataagtttacccgctgttttaccaaagtgttcttccactacttcagtaatatcgctgccaggattttttgatgaaagtacaaagtaggctaagccacggtgagcaaaataagtcattggcccgacgataattgccattaaaactaacggccaaaatccacccatccctgcgttaatcggcaagaacaatacgcccgcgccaaccgccgtaccgaaaaggtttaacatccacgttgcatcaaattttgtcccatttgagttttctgttgatttcatagtttgctccaaagcataaattacttaaatttgtcaatttgtagagcaaaatccgctccaactaaatttgagtattatgttatgccaataaatagagaatctcaaagagcaaattctaaaattgtgatcaagttaaaatttttttataaaaagtgcggtaattttcagcgacaaaaaaatcggtgcgatgacgacaccgattgcgtataaaaataaatgaaattagaaccgcacttttttcaatcttaaggcgttcatcaatacggaaattgagctcaacgccatagcagcaccagcgattatagggctaagaaaaccgaaagcggcaaggggtatgccgagaatattgtaaatcaaagcaaaaaatagattttgtttgatatttttcaaggttgctcttgcaataaaaagcgcatccacaagttgattcaccgaatgttgcataagcgttgcagaggctgtttgttctgcaatatctgaacctgatttcatcgcaaaactgacgtttgcagaagctaaagcaggcgcatcatttattccatcgcctaccattgcgacaatatgaccttgagctttcagcttttggatttgttccgccttatctctaggactgagtccaccaaaggctttcttaatgccgagctgttttgctatgtaatcaacgacagattgttgatcgccactcataattacgacatcaatattttgctgttgtaagcgttgaatggcgtgcaagctatcgttttttaaagtatccgtcagtgcaaatgcaccgatgggttcatcatttatggatactgcgacaatgctcgcaatttgccaaatatcctctaaatttttaggcaagattaaaccgcaataatcaggtttaccgacttttattgttcccacttgttctaattcggcttgaatgccttgacccacttccatctttgaaaaaagtgcggtgggaatttctaacattttttgttctgctgcttgcacaatagcttttgcaattgggtggttagcttgtcgttcaactgctgctgcaaaacgatacaaatcgtcttcagaatacaccgcactttgtggctgccataaagcagagatttcaagctctccttttgttaatgtgccagttttatcaagtacaacggtatccacgtgggcggtttcctccattgcagccgcatctttaaaccatacgccagcattgactgctttacctaaaccaaccattatggctgctggtgtggctaatcccaaggcacaagggcaagcaatcacaagcacggataccgcgtgaattagtgaagacacactatcattcgtcagaatataagtgagtgcgaaagtaacaagtgaaatcactaaaacgacaggaacaaacacggaagcaactttgtcagcaaatcgagcaatgggtgcttttgaaccttgtgcatctgataatgcattcatcatatcgccaagtaaggtttggctaccaagctgatttgcttgatagataatagaaccttctgttaccatcgcccccgctaatacttttccacctttctgtttttcttctggacgagactcgcccgttaaatggctttcatcacaccatccatttccactttcaattatgccgtctgccgcaatacgttcgccttgattcgcacgaatgatttcgccgatattgacttggtcaagagcaatttcagtccatttttcattacgtaaaacagtgacttttttcggtgtcagttgcaagagcatactcaagctatttaagctatgctttttagtgcgatcttcaagaaattttccaagactgacaaaaccaattaccattacagaagcttcaaaatacacatgccccattgcatgatcggcgtggtaaaacaacatgaaagcagaataaagataaatagtgagcgttcctgtgctgacaaggacatccatattggcaagtccaccacgaatactaccgattgctccgcaataaaatggaatggctaaccaaagttgcacaatgcttgctaatgcaaattgccaaatcggcggtaacattaagtgatgggagccacctatcataccaagcattccaatcagaaatggaatattgattatccaaagtatgattaatcgccaagggattgatgtattttcttctattggtaattcattggcttgtttgatatgagcagaaaaacctgttttatggataatctcgataatttgagtttcgcttgcttgcgtagcgtcaaatacaacttgtgcttcttcgacggcaaaattcactcccgcttgttgcacaaatggttttttatttaaaactttttcaatgcgattggcacaagattggcaggtcatcccaccaatctgaattgaaatttttttactctgtggcgtcaaatccagcatcttcaatgacctcaatcaactgtgcaacattgactcgattttcatcaaaagtaatatttgctttaccctctaattgcacatcagcagattgtacgccatctaattcagttaaaacttgagtaagactttttacgcaacagccgcaatgtatgccttttatgtttaatgtgatagttttcatttttactccttgttagttgttttattgatgaatgcgattggcacaagattggcaggtcatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgatgaatgtgattggcacaagattggcaggccatcccaccaatctgaattgaaattttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgattgttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttggattttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcaaggcaatggcaaccctgaatgttcaattttgaatggcttgaacggataagtgaaaagtgcggttaatattcccaactttctggatcgacgcctaattcacgcataagcactttggcatcttcgggaatttcatcattacgctctttcattaaatctgcatcagtgggcaaaggctgccctgtgaatgcgtgtaagaacgcttcacaaagcaattcactgttagttgcgtgacgtaaacttttcaattggcggcgagtgcgttcattcgtcaaaatttccagtactttaatgggaatggatactgtaatttttttgacttgctcactttttttgccatgttctgcataagggctgatatattttccgtcccaatccgccataatttcccttagagcttatcgataaccttacaaattgtccgtattctaattaaaaatcaaataaataacaatctagacggctaaacttccaaaataagttctaaaaaagtgcgatgatttttatattaaatgctaataaaagctagacagcgtagggttttagtggtaatttatgcgccattcaaagggtgcaagcccaccattcgaataatcaattcttattaattccaacatttattcattatgcatttaacagaacttaaaaatacgcctgtttctgatcttgtgaaactcggcgaggagcagatgggcttagaaaatttagcgcgtttgcgtaaacaagatattgtctttgcaatcttaaaacagcacgccaaaagtggcgaagatattttcggcggtggcgtgctagaaattttaccagatggttttggtttccttcgttctgccgacagttcctaccttgcaggccctgatgatatttatgtttccccaagtcaaatccgtcgttttaatcttcaaactggggataaaatcgaaggcaaaattcgtccaccaaaagaaggcgaacgttattttgcacttttaaaagttgatcaagttaatgacgacaaaccagaagtttctcgtagcaaaatcttatttgaaaacttaacaccattacatgctaactctcgtttaagaatggagcgaggcaatggatcaacagaagatttaaccgcccgtattttagatttagcctcgccaattggtaaaggccaacgtgggttaatcgtagcaccaccaaaagcgggtaaaacaatgttgttgcaaaatattgcgcaaagtatcacgcataattaccccgatgtggaacttatcgtattattgattgatgaacgcccagaagaagtgacagaaatgcaacgttccgtaaaaggcgaagtcattgcgtctacttttgatgaacccgcaactcgtcacgttcaagtggcagaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggagctgcacgtaatgtggaagaaggcggcagtttaacgattattgcaacagcactagttgatactggttcgaaaatggatgaagtaatttttgaggaatttaaaggtacgggtaatatggaattgcacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaaaaacaaccgcacttctatgaagaacaagggaaaaatattatgttttcccctttttaatatccgtaatatttgacgagataaataatgatagccgataagttcataaaaggggcaaaaggtataaattcttttttctttttatgaataagcgaaaaacatattccaagcactgaggctaataataaaaagtgcggtaaggtttctaaatgaataaaacttcctaatgccattgctagccaataatctccccgtccaaaggcttcttttctataataacattttgcaatccaatagattgcgtagaaaacaataaaaaaactagccgcactttttatgctttcagataacgttagcaatgaaaagttattgtctgcgccaaataaaccgagagtaagtaaccataaacagggtgtcgtagaaataagttgatagtgccaatcaagataactgattgtccaaagaataataagtgtgagtccgatccatacagtaaaaatagaatctttgaaggcaatttgtaaaaatataaatccaaccccaatactaaaaaaatacctcaaaatatgaccgcactttttttgttgaatagaggcaaagtgcggttgaaatggagaactgttttgtggaaataattcaacgtaagtcgcataaatctcttgctgcaaatgcgtaataaaaccagataggtagaaccacaatgcgatccctaagatgccgcctaataaaaacattgtgaagtaaatcattgaataactgatcccatattaaagataggtaaatacattcccatcataataatcccaatcagactgccgatgattaccatcattaatggttctagcatttgtgagagtaagtcaatttgatgattaagtttttcttggtaattatctgcgatatgctctagcatcaaagcgagttttccgctttgttcgccaatttgtagcatttgttgtgcttccatcgggaaaagatcgctacttacgctattagaaaacgcatagccttgagaaacccattgcaaaattgaccgcacttctttatctaataccatatcgtttacaagcgttttcttggtttgccaagtttgtgtgcgaggaagaaaactgtctagtgcctgattaagcggtacgccggcctgcaacataatttgtaaactttgactaaagttcactaaacgtgaaagcttttgaattgtgccaaaaataggcgtgatagaaataagttgatttttcttttgatgaaaccaagtctggcgttttagatagaaataataaaatagaaaaaaactcaaaacgaaaaatagcaaaatgccaatattttgcttaaggaaattagatattgagagcaatattgcggttattgttggtaactccgcattattgccactgtacatttcagcaaattgaggcgcgataaaaagcagtaatgcgagtgtcaataatagagaaattcccaataccattgagggatataacataattttctgtaatttgcgttgtaaagccaaagattgactacggtgcgtggctatttttttacaaactacggcaagttttcctgtcatttctcccacttgaatcagttgaatttcttgttgtgtgagatattttccttgttgttcaatggcttgtgagaatgctaagccagattcaatggattgaagcagtcgttcaagccatttgttgagcataatttgagtacaattttgttgcaaaatttgtaggctgttttttaacggaattacggactgtagcaatgtcgctaattgattgagtaattcactgatttctgaatttttgggttttgccccaaattgccagttttgttgtaatttgatgtgagtaagcccgcggcttattaactgaaagtgcgcttgttgtttcgtatccgcaataattgagcctttttgtttctgatttaatgcgttactaccttgataataaaagagttttttagtcatgagtttttacctaacacacgttcaatttctttctcatctgttatgccttggctaactttttccaaaccactctctcgtaaattctcaaaatccgtttgatagccattctgttgccaatgtagaaattgatacacgccgattcgccctcgataaccttgatggcaatcacaagaatttattaaatttccaccgcactttggacagatttttcgtacaagacgctgtgcaatgacgagtagtaaactgttttcaatttcatgttgttgaataccgagttgttgtaagcgagaaatggcagatattgcatcattggtatgtaaagttgaaagcaccaaatgtcccgtttgagcggcacgtagtgcaatccttgcactttcttcatctcgaatttcacctagcataatgatgtcgggatcttgacgtaaaaaagcacgcaatagacggctaaaatctaatccaatctgcggattaatttggctttgaataataccatcaagttcaatttcaatgggatcttcagcggtcataatatgtttatcaggcgtatttagccactgaagtgcggtgtaaagcgagatacttttcccacttcctgtggggccggttactaaaattaatccttgtggctggctaagtgagcgttgaaatgcttgttgctgattttcggtcatacccagttcagcaaagctaagttctacaggtttattttgttgcgctcgcaacacgattttttcgccccaatgggttggtaaggttgaaaggcgaaaatcaagaatatcggaaaaagtggttttaaattgaaatcgtccatcttgtggaagtcgattttcactaatatctaatttagccagtaattttaagcgtgaaataatacgattggcgaatattttgcttattaagggttgtggttgtaaaacaccatcaattctaaaccgcacttgaaactgatcagccaaggtttctaaatgaatatcagaggcatttttttgtaaggcagattcaaaaatctgattaagtaagcggataacaggttcatcatcttcttgttcaaaatgggtttcttgatgttgatagaatttaacttgctcttccacttgcatttggtgcggagtaagttgttgtaacagttctttgagttggctgctttctaacaaaattggttcgacaggttttcctgttataaacgcaatggtttcacaagctgaaagattggagagagaatcaacccctagccaaagacgattattttcttctttaagtggcaaagcaaaataccgcaagagcaaggattgttgctgctgattgcgttcccataaatctggcgagatcgtaaagatctcgccattttgagcggttacacgctgagtatgaagtaaagcatagctcgtcattgtgtgacacttccgcaaaaatttgctggaaataaagaggcatccgttcctttgcaagttgttgtccaagttacacctgttgcagcattacctgtagcttgcaaaatatattccatatttgccaatgtgccatccccttttactgttattgcaccgttgcttgttgtcactgattttacatagccttttgctgtggttatatctgctgcaataccattttttccacccgtacagtttgttgtttcatttgtgctatatacacataattccacatcagccttataaggcgctgacgcttgcagtaattcagataccgctgcttttttagtataattttgataagagggaattgcgatagtggctaaaatagcaataattgcaatcacaatcattagctctattaatgtaaacccttttttcaaggtttgctgtgttgttagtttcattcattttccttttattaagcctttgttagcgacgacattgtgaaaaggaaaaatttgtttgtaaaattgaccgcactttttctgcgatcctgatcgcaaaaaaaggaaaaaagtatgcaaaaactaaaagatattgaacaaggtatattggattgtcggcaaattcagtcacctcacttcgataaacgcccaaatccacaggatatttccttattggttattcattatattagtctgccgccagaacaatttggcggcggatatgtggatgatttttttcaaggaaaattagatcctaagattcatccttattttgcagaaatttatcaaatgcgtgtttcagcacattgtttgatcgaacgaaatgggcgaattacgcaatatgtcaattttaatgatcgcgcttggcacgcaggcgtatctaattttcaaggacgagaaaaatgtaatgattttgccattggaattgagctggaggggagtaatgaacagccttttaccgacgctcaatatttttcattgcaagagcttactaacgtaataatgaaaagttacccgaagattacaaaagatcgaattgttggacattgcgatatttcgccaggacgtaagatcgatcctggtcaatattttgattgggaacgttatttatccagtgtaaaacaaactgtataaaaattaaacatcaaattttgatgtattctgtgtattataaatgcgttcactcttttaattctaactagttgaattaaaaggaataaatttaaatctgaaattttattaaaaaagttaatttgagttatacaacattatagattttctcaaccacaattttatccacagaaatattgaataactcaaagagatgataaaaagatcttttgtgaataaaactgttttaaaaattgtatttttttaccgcactttcttccattttgaatgtgaaaagtgcggtttatttttgtttaagatcttttggttgtaaataactcaatttattttgaagtttgatgtgataaggatctttgcctgtttttacgagatcaattcacaatcagaaatccgttattcacaatgttatccacaacataggtacttttcgtcatataaacaaaataagaatattttgttgtctagaagtttcccctctccgtaaaattgtgtatttttaaccgcactttaggttcaaacccaatgtgcagttatttttattgattttcctcttttcgctttttgctcttttttttaaaatatgatactttttcgccgtcaataagacatcaaacacaaatcaatatgaacgacgaacagcaaaattcaaaccaacctgaaaatacgaaaaaaccttttttccaatctttattcggtcgcttttttcaaggcgaattaaaaaatcgtgaagaacttgtggaagtgattcgcgattcagaacaaaacgatctaattgatcaaaatacgcgtgaaatgattgaaggcgtgatggaaattgcggaacttcgtgttcgtgatattatgattcctcgttcacaaattatttttattgaagatcaacaagatttaaatacttgtttaaacacaattattgaatccgcacattctcgttttcctgtgattgccgatgccgatgaccgcgataatatcgtgggcattttgcacgcaaaagatttattaaaatttttacgtgaagatgccgaagcatttgatttatcttcattattgcgccccgtcgtgattgtgccagaaagcaaaagagtggatcgtatgttaaaagattttcgctctgagcgtttccatatggccattgtggtggatgaatttggtgcagtgtcggggcttgttactattgaagatattttggaacaaattgttggcgatattgaagatgaatttgatgaagaagagattgcggatattcgtcagctttctcgtcatacttatgcagtgcgtgcgctcaccgatattgatgatttcaatgggcaatttaatacggattttgatgatgaagaagtagataccattggcggtctgattatgcagacttttggttatttaccaaaacgtggggaagaaattattttgaaaaatcttcaatttaaagtgacttctgcagatagtcgtcgattaattcaacttcgcgtgacagtgccagatgaacatttggcagaaatgaataatgtagatgaaaaatctgaataggattttattatcaattaaatttatgaataaatatttaacttattttattgcttttatatcgggtttagtcggtgtttttgccttttcgccatttgattattggcctttagcctatgtgtctttactcggtttactttatgtcgctaaaaatcctaaaaaatccaccgcacttttatccactttcttgtgggcgatgggatttttctgctttggagtaagttggcttaatgttagtatccatcaatttggtggcgcgtcgttaggagtgagttatttccttgtcggtttgcttgcggcttatcttgcgctatatccaatgctctttacctatttagttcagcgtttcaaagtgcaaagtgcggtaatttttgccgtgatttggacattgacagaatttttacggggttggatttttactggttttccttggcttcagtttggttatacacaaattgacagcccattttatggtctcgccccgatttttggggtaacaggattgacattctttaccctttgggcaagtgcggtcatttttaatctcgtttcatctttgtttaaaacgaaaaattttaaattagttttagcgaatgctttgttattgattattgtagggggattaagtgcttattcatcgcgaattcactttgtaaaatctgttgaaaataaggcaatttcagtcacgcttgcgcaaggcaatattgaacaaaatcttaaatgggatcctaattatttctattctactttggcaatttatcaaaaattaatcgcagaaaatcttggtaaaaccgatttaattattttgcctgaatcagccttaccaacccttgaaaatgcaattacaccattttttgaaaaattagagcatgctgctaaagaaactaaaacggagattatgattggaacggtattccaagatacaaaatctggtaagttattaaattcaattatgactactggaaacccagattttccttatcaaccagatacgccaaatcgttataataaacatcatctcgtgcctttcggggaatatgttccgctagaaagtattttgcgaccgcttaattcagtgtttaatttaccaatgtcagcatttcaaagtggagaggctgttcaaccctctttaatcgcaaaaaaacgtgctttttcgccagcaatttgttatgaaattattttcggcgagcaagtgcgacaaaatttgaaacaagatacggattatttgctcaccttatctaatgatgcgtggtttggcgattctattgggccttggcaacatttacagatggcaagaatgcgcgctttagaattaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataaaaacaccagttaaaatgaccgcactttttcattcatataaataaacattatgcgcataccaagaatttatcatccaatatcccttgaaaatcaaactcaatgttatctttcagaagacgctgcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacactgagcggatggataaaaaaatccaacaatggcaaaaaattgcgattgcagcttgtgagcaatgcggtcgtaatagcgtgccagagattcgtccactgatgaaattacaagattggtgtgcagaaaatgatggtgcattgaaattgaatttacatccacgcgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggacttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcattgcggaactttattcaaaactcaattttatgatgaaaaatgaccgcacttttggtaatgaaatggtggttgcgggtgggcctgtgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaatgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctttaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattagattcacattgtaaaaataaacttcattttagaatgattaaagcgcgattttataatcttgctttttcgccaccaaattcatctaataaattttcggtgagtttggctaaaataccagtcatcagtacaaaatctgcatcgaaacgctgtgcaaaatcttctttcagaatatcatcatttttttcccgtacagtatctgcaaattttaaacgtttgattgtgcaatcttcgttaaaaacgaaagttaaggtatcttcccattctaaggctaatttacttactacttttttgccatcttgcagaagagcgagaatttcttcattttctaaaggttgttttttgcaacggataacgctgtcttcctgactgccacgaagctcggcttcttctaatgcaagtaaccaatgcggcaaattatcttgaaggatccaattggttaaaatcgtgctaggttcattagcaaaggctaaaggcacgacagggagcgaacctaaggatttacgcagtaatgcgagcgcatcttccgcgcgtttacttgatgcggcatcaatatgaataagattattttccatatcaatccatagtgccgtatgctgatttttactaaatgcacgaggtaataaattcatcacgacatcatcttttaatgtttgtttttctacctttttaagtttgcgattttctttttttcaaggctttcaatgcgttcatcaagttcacgtttgaccacatttgccggcaagattttttcttcttttttggcgattaatagaatttgttttccaacagaaaaatagagtaaatcagaacctcgtaatggggctgaccagccaaatttactttgatcttgagcaccgcagggatggaattgacaatcttctagttgagtttgtagttgtgtaagatcccaatctagcggtttagtcagtctataagtcattaaatttttgaaccaaaaattaactttataactcataacatttcaccatgtacaattttatcattaaatcaataatttacttatttcaaaacaccatttataattcatagtatatcatcatatttcaattttttagtaaccataatggtaacttatcacaatcaagctagatttcttggttactaaaaaatatattaatacctatttttatatacataaacagatgtcttatggctaaaaaagtaaaaccacttgttgacactgaaatcaagaaagcaaaagcatcaaacaaaccatatacattgactgatggttatggactatttctaatcatttcaccaacaggttcaaaatcttggcggtttaattactatcgacctataacaaagaaacgagcaaaaatttctttaggcctatatccagcaattacactatcaaaagcaagggagttgagagaacaatatcgtcaattactagctaataagattgatccgcaagaatacataaaacagcatgaattactgcaattacaacgacaaaacaatacattttttgccatatcaactcaatggaaacaaaaaaaagtttctgaaatcaagtctgtaacacttaaaagccgatggagaacgctagaaaaatatgcatttccatatttaggcgataaccctattgctgaaattacaccacaacagttacatgatacagttataccattatttgaacgaggagtttctcacactgggaagcttgttattgcattagttaatgaaatcatgaattttgctgttaacaaaggtattattgagtttaataaatgcatcaatgtatcaaaggcttttaatgtaaacagaacaacacatcatccaactattagacctgaaaaactacctgaattcatgtctgcgttacgtcattcacatattgaccttatggtgaaatatcttattgaattctcccttttgactatcacccgtccaagtgaagctgcaaatgcacaatggaatgaaattgattttgagaaatcgctatggaatatccctgctgaacgcatgaaaatgaaaaaagctttcaccattccattatcactacaagtgcttaaaatacttaataagctaaaaaacatttcaggccgtagtcgttttatttttcaaagccaacgttatcctgaaagaccattacattcaagctctgccaatgcagcaattaaacgcgttggttataaagatcaattaacatcacatgggctacgttctatcgcaagcacctatcttagcgagacatttaccgaaatgaatctggaaattcttgaagcttgcctttctcatcaaagcaaaaatcaagttcgtaacgcctacaatcgctcaacctatcttgaacaacgaaaaccattaatgaatgcttggggagattttgttgaagaatgtatgaaaaaaagtatctaaaaataaagggaatcaatactgattccctttatttacctaacctttcttcagtaactctaccatttctctcagtagctttatttcattatctttttgctctactagcttattcaacaaaccttctttttcttccaataattgctgacaatgtgataacgataattttagtttttcaatctcaatcaatagagatttctcattgtctccctgaaatgacgaactaaaatgagaattctcattgaattgaacgaagacatttcgttcaccagaattaatcaattcaacaatatctatatctaaaatctgtgcaatttgctctagcttatccagatgtaatttcgtttcaccacgttcaatttttgcatagccattcaatgacatactcattctttcagccatctcttcttgtgaccaatgctttgtttcacgtagttttctgatcttttcatgtacgttcattcttatacccataaataggttaattttttacaacaaactgtgtgctaactatacatcgattgttggtagaacgcaaaatctctcttagataaaatttacaaatacaactatactggggatatttatgcttaaatctatacttaaaccaataggacatatactaaaacttctaataaaaactgctttattcttactttcattattattcatactaatgctaattatcggattcgttgataacaaaaaaattccaaccgaatttattgtttttgggattctaggtatttgttacatttgctacacatttaattcttgggcaaataagcctgaagtctgtccagtctgtaaatcaggcaaaattgaattggattcaattaaagaaattgaccgctggctgggaaaaactaaagtgcgtgaaagaatggcatctggaaaaacacgagaacgatatattcaatgcacgaaagtaaaaaaacgatatacatattgttgccaaaatcctaattgcaagcatacatatactaaaatacgggaagaagaattataggtgtaactatgttttcaaccgctataattgaaaaaattaattattacatctattgtcttgttgaccctagaaatcaaaatatcttctatattggtaaaggtattggcaatagagtttttcaacatgcacaaggtgcattaacttgcaaaactaatgaaaatgataaaatatcactaatcaatgatatacataaagatggacttgaacccttatactatattttaagacataatatcaaggaggaaaaacaagcacttgaatatgaggctttagcgatcgatttattatccattgttaaacctaatcaacaaccattaaccaatattcaaggtggcacacattcttctgaaaaaggtttaatgtcattatcagaactaaaacatatatatgacccacaagaattaaaaacagatttacctgttgttttaatcacaattaataaaaactataaaaaattaaaacaacaaataaaatcaggcgaaattgataaatcgcaaattgaaaaagaaatttacgaacgcactcgcggctattggaaaacgggttcacgccgtgaaaaagccaaatatgctattgcagtttatcgtggctggacattagcagcctacgaaatttcatactggattgaagcacctattgagcgtcaaggtcgttggggttttatcggtaaacttgtgccgaaagattctccaatttatcaagaacttgttaataaattaacctattcatcaaataatgattacaaggcgccacaaaatccaataacttatcgtaattgttaatatttactttaatggaatcttaaaatgaataaatttttaattacatctatatttctaataacaaatattacatatgcaggaatccgtactattgaacttccgccagaacaatccggttcaatagctatgaaatgtggagactatatttattttggtgaaaaacgttcatcttacgatgtctgcatgataacaggcttgttaaaaacatatgaaaaaggtcaatgtattactcatgatgaatacaaacttttaaacaaagcatgtagcactaaacccgacaatgttccacaagcctacaaaatgagagattcatcttactatgttgaatactcaccagaaactgatggttttgtaccaatgagtagtgaaaactaaaatcgtcataaagagctcaaaaatgagctcttttttcattttatgtattacatataggttttatcattctaatcaactaaatgcatctagacatcatttagaattattctggcttacattaaatacctatatacatttatcaagtacagtgaacttaaaatgatgaaaaaatttccaaattttaaaccgcattctgacacggaaactgaagaattaattagcttactatttagaaaactcgatattgatgaactaatctttctgctacgtgttttacaacgtgatatccgtgcaaaatatacactcacaaaaataattaaaaaaaatatcaatttaaagttagattcataaattcctgtgttaagctcctaaaaagtatgtacgaaataggagataattatgaaaatacaagataacgtcggctattacttcacaattcaagatcttcaagatcgtttacgtgtaagtcgttcaactattctgcgattaattgaatcgaaaaaattaacatctatcaaatttggacgacaagttcgtattcctgaatcttagattctaagttaccttgaaacttgtaaagtataaaaaaataagccaccaaaaacatggtggcttttatttactatcttttatatcgtttaaaacacatcttcgcactgccttctgatattgataaacaggttgctatttctcgccattttagaccttgtgttcttaactatactattttctcatatttactttttaagtcattttgtgatttcacccatccgaattcttctgaccaacgattcaatgagcttacactaatactaaattgttctgctatttgctttaacgacatattaggtttattagctccaaattgattaaacaactctttcttgataatttgttgcttttcccatcgttttcgagaacgatttgactgaatttgttgaaacgatgattcagaaaatctttcccaaatccaacgagatgaacttctagcaattccttttaactccctgtatggtaatggtggattatgattctgatttaataactctaatgaagataataaatactgattaaattgttctaattgtttacctgaacatttaaacttcagaacctcacgataaccaatttttttgatctgattaaataaagaacaattccgaccttcaatatcttcattatcatttagataaaatacaggtttatttgataaatcaacaaaatcagctaaataatccagagtatatttaggtacattaaatacaaatgttctccaaaaatttgagtttggatttttagtgaatacaccaacatagtgttgatctgctcctaacttatcaatataagctcgttgtatctttttaaaataacttattggcttaaatcgagcattctttgtgttacaaataggtacctccaacgcatagatataatgacatcgaccgtttaatctattttgtaccactatattgggacttggaagtcctaacaattcccaatccattgcagaattttcccgatctagatctaacaccataaatttaataaacagatcattaaactgaatatacttatgagttaatgcaacatctttagggtataactgcaccccattatcaaaattatctgtctactttatccgttctgctaagctttgattaaaatcatctaatgtatatgctgattccatatttacctctttatatatgattgaatttatgtggtagacatatctatctaatatgccttaactgagattaatacaaaaaaagtattttttaacttaatatgattattttttagacacttaaaacatgaaaaagaatcgaatgcctaaatcttaagcaaaaaatatagatttgtaacaaaatatcatcccatatcagatattaataatttaaaagtaatataaaataatatctaattaaattagatctcaataacttgatgataaaaatattgtttaaggcatattacaaattgaatagataaaatttagagattttttggatacatcggatactttttgatgtattgtatatactagagataatgttacatataatcagtgaacaagtaataaacagctacaatgtacacacctaaaaatagtaaccaatttggtaaccaattatcaaaacatgaaagaagattgattatatttacaatggttagagatgatctatttaatttttgaaccacatcgtaacacttccttcaatatagggtagaatgtgcggtattatagcccataaaagtaggaaaaacgatgcaacacaaattgattgcctttattggtggcggcaatatggcacaagctattattcttggattattgaaacaaggttatcctgccgagcaaattattgtgaatgatccaaatgaagaaaaaagagcattttttgccaatcttggcgtggcaacttcagaaaataatgtggaaagtgcaatcaaagctgaggttgtgttgcttgcggtaaaacctcaaatgatggctgatgtttgtttgccactaagtgcggtggatttttccgataaattgttaatttccattgctgcaggtatttcaactgaacgcttgaacgcattaattccaagcgtaaaatcgatagtacgcgtcatgccaaatacacccgcattagtgggggaaggcatggcggggttatttgcaccgaaaaatacgagtgaaaattaccgcacttttgcacaagatttattgggagcagtgggaagaacggtttgggtggatgatgaaactcaaatgcacgcagtcaccgctgcttcaggaagtagcccagcctatttctttttaatgctggaagcgatgcagcaagccttaatcaaaatgaatatagatgaaaaaacagcacgtgaattagtccagcaatctatgcttggtgcagcaaaaatggtgaccgaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctgatgcaagttcgtcctttttattggctcgcactgagctttctaggttactactgcgcttatggcgtatttttgcctttctttcccgcatggttaaaatcacaacaatatggggaggaaatgattggtttggttatcggcagtgcttatattttccgatttgcgggcggattatttttttcatcgctgattaaaaaagccaatcatattattatttccttacgcctattggcgttagcatcggcaattattatggcggctatgagtttagttgcgcataatttttggttgttgtttattgctatcggtttgtatgcttctgtgaattcagcaggaatgccgattggggattcgttggcatccacttggcaacgccaaatcggcttggattacggcaaagtccgtttgattggttctgctgcttttattcttggtgtagtagtatttggtggcatgattggctgggttggcgagcaaaatatcgtgtggattttaaccgcacttttatctttctataccatcattcagcttttaaaaccgaccattcccccaaaagatgaaatacctgaaggtggcgttcaaaatgatgttggttttattgctttactgaaaaatccgatgacattacgagtcatggttgcagtagggctgattcaaggctctcatgcggcttattatgtttacagcacgatttattggacaagtattgggatctccgtttctcaaactagcttactttggggcattggcgtattagcggaaattgtattatttttcttctctcgtcgtttatttcaaaatatttctatcagcgtactgctttatatttctgcgcttgcgtgcatcggacgctgggctgtaataggatatattgacgatttctggttgatattcttattgcaacttatacacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgcagcattttttgtgattccacgcaagttaaatgcctttttgattgttcagcataaataggacgtatcgctttccttttaaaaaagtaatatgaaaaatcttgcgctcattgatttgtttcttaacgaatattggattgaaaaagggctttcagaaaatactgttcaatcttatcgtttggatttaaccgcactttgtgattggttggataaaaacgacttgtctttggaaactttagatgctgttgatttgcaaggttttctaggagagcgtttggagaaaggttacaaagccacgagcaccgcacgaatgttaagtgcaatgcgtaaacttttccaatatttatatcgggaaaaatatcgagtggatgatccaagtgcggtgctaagttcgcctaaattacccagtcgcttgccaaaatatttaaccgagcaacaagtgtcagatttgctcaatacgccagatgttaaagtccctttggaattgcgtgataaagcaatgttagagttgctttatgcgacggggcttcgtgtaacagagttagtttcgcttacgattgaaaacatgagcgtgcaacaaggcgtggtgcgagtgattggtaaagggaacaaggaacgtattgtgccaatgggggaagaagctgcttattgggttcgtcaatttatgctttatggtcgtcctgtgctattaaatgggcagagttctgatgttgtgtttccaagtcagcgcgcacagcaaatgactcgtcaaactttctggcatcgtgtaaaacattatgccattctcgcggatattgatgctgatgcactttcccctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataatttcggggtaaatttttatagttttaaagattgattgtggatttcttattgattaattaatttgacacgcatcacaaattttgaataaaaaattagacagctcaagcatattttgctatcttgcgaagaatttcgacatttgttctatcgaaaagtaattttggattctaaaatgaaaaaaatcacgcttttttttaccgcacttttatgcttattttcaacttctgttttagccgaacctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaattaaaaaagccttattgagtacaataaggcttttttagtggttaaatttatctagtctgataatttctgcaaaccaaaatgacgataagtttgcgatgttgcaatacggccacgcggcgttctttgtagaaacccctgttgaatcaaataaggctctaaaacatcttcaatggtatcacgttcttcgccaattgcagcagcaagattatctagccccacagggccaccatcaaaacgctcaataactgcagacaacaactttctatctaaataatcaaatccagcatcgtctacatctagcattgaaagcgcttgttttgccacatttatagaaataataccgccattacgtacatctgcataatcacgcacacgtcgtaataaacggtttgcaattcgaggcgtgcctcgtgaacgacgagccacctcaaaagcggcttgttgttctaattcaagatttaaacagtccgcacttcttgcaacgatagatgttaaatcttctacagaatagaattccaaacgttgcacaataccaaaacgatcacgcaatggagaagtcaaagaacccgctctagtggtcgcaccaaccaaagtaaaagggggcaaatctaatttaatggaacgagcagcgggtccttcgccaatcataatatccaactgatagtcttccattgctggataaaggacttcttcaatagcaggggaaagtcgatggatttcatcaataaataacacatcatgcggttcaagattggttagcattgcggctaaatctcccgctttttctaatacaggccctgatgtcgtacgaatattcacgcccatttcatttgccacaatattagcaagcgttgtttttcccaaacctggagggccaaaaatcaataaatgatctaaggcatcttgacgtagtttggctgccttgatgaaaatatccatctgctcgcgtacttgcggctgcccaacataatctgctaatagtttaggacgaatagcacggtcgataacatcttcatcaaccttagcttgcccgctaataattctatctgcttcaatcatatttttcctacaatgcggcttttaatgcttcacgaataacttgttcactggttaattcaggtttagcaacgcgttttaccattttttctgcttctgcaggtttataacctaaagcaatcaaggctgaaattgcttcatcagatgaactttccgagtgggattcaatagatggggataatggaatatgcgtactttctacaaagaaatcactttgttttatgcctttaaatttacctttgagttcaactaacaaacgttcagctgtttttttgccaacacctggaattttagtgagtttagaaagttcttctctctctattgcgtaagcaaattgttcgaccgacatggcggataaaatcgctaaggctaatttaggcccaaccccatttgttttaattaattcacgaaataaagtgcggtctgttttctgggcaaatccaaagagtaagtgagcatcttcccgaacaacaagatgggtgaataaagtagtttcttgtccaatttctggtaaatcatagaaactcgtcatcggcaaaagcaattcatagcctacgccttgcacattgagtaaaatttctggaggttgtttttctaaaagaatgccttgtaagcgaccgatcataattcttccgaatgataaaaaaattaacgcatagaataaaataaaactggacgaacatccagttaaatttttaatctaaagcgtcctcggctatatctggtctttaaaagtgcggtcattttttcttgcgtttctgtcattttcacagaattggcaatatgtaaagaatgttgaatagaatgagcgtgtgtaatcgcaatagccaacgcatccgcggcatcggcttgaggtttatctgataacttcaaaatacgagtcaccatttcttgcacttgtactttatcagcagaaccaatgcccacaaccgtttgttttactaaacgtgcggcatattcaaaaacaggtaaatcattatttaccgctgcaacaatcgccgtgccgcgagcctgcccaagtttcaatgctgaatccgcattcttcgccataaacacttgctcaatcgcaaacatattaggttgaaattgcgtgatgatttcagttactccagcataaatgcgtttcaaacgggtgggtaaatcttcaacttgagtacgaattgcgccactaccgagatattctaaatgtctccctgtttggcgaatcacaccgtaacccgttacgcgagagccggggtcaatacctaaaataatgctcataatttctataaaaaataggtaattaaattacccatttattgcattattaaagttgagatgccacttcgtcacagatttctccgttgtgatatacgttttgtacgtcatcacaatcttccaacatatcaattaaacgaagtaattttggtgcagtttcaatatcaagatcgacggttgttgatggaatcatcgttacttcagcttcttgtactttaaaaccagctgcttcaatgccatcgcgcactgaacctaaatcttcccaagcagtatagatttcaaatgaaccatcatcttgtggttgaatatcatcagcacccgcttcgattgccgcttcagttaaggcatcttcatccgcttctgcgattaagattaaaccttttttgctaaataaataacccacagaaccttctgttcccaagttaccaccacatttagtaaaacttgggcgtacttgtgagatcgtacggtttgcattatcacttaaacattccaccataaccgctgtaccgcctgggccataaccttcatagattttggtttccatattggtatcatcgccaccacctacgccacgatcaatagcacggttgatagtatcgcgcgtcatattgttgctaagtgctttatctactgctgcacgtaaacgcgggttagcactcacatcgccaccaccaattttagctgcggtaacaagttcacgaattaatttagtaaaaattttaccgcgttgtgcatcttgtgctgctttgcggtgtttaatattagcccacttactatgacctgccattttatttccttctatttatctttaagaatatattttctaattgcttccgcattattggaagattttgtcatttggattgcttgttcaggggaaacccattgatatgccaaatgctcactcaatactggaataaattctttttccgcctcacacaaaaacaaatgttctttgcagtgagtaatattcggtgcgtatttatagcggaaatgtggaaaaatttcaaattctatgctctcattgcaatcaaaaagcgcggtggaattttccgaaatttctaaccgcacttcttcccatagctcacgaattgctgttttttttggtgtctcaccactttcaatggtgccagtaacagactgccaaaaatcaggatcatcttggcgttggagcattaaaactcggtttgtatttttagcgtaaattacaacaagaacagattgattatttttgtattgcatcattaaaaatgcggtcaaatctgaccgcacttcattcctaatattccaaacttattctgctttaacgacagaaattgccaactcttccaatgcttgcggatttacaaaactcggggcttccgtcattaagcacgctgctgccgtggttttcgggaaggcaattacatcacgaatgttttctgttccagttaaaagcatggttaaacggtctaaaccgaatgctaaaccagcatgcggtggagtaccgaattttaatgcatctaataagaaaccgaatttctcgcgttgttgttcttcgtcaataccaagaatacggaacacagtttgttgcattttcggatcaaaaatacgcacagaaccaccacccacttcgtagccgttgatgaccatatcgtaagcattggctaccgcacttgttggatcagcctctaattgctctgggctgaaatcttttggtgaagtgaatggatggtgcattgctgcaagattaccttcttcatcacgttcaaacattgggaaatcaatgacccaaagcggttgccattcgtctaaacgagttaagccaagatcacaacctaatttcaaacgtaacgcacccattgcatcagtggtcgtttgccatttgtctgcaccgaagaataaaatatcgccagtttgtgcattcacacgttctgctaacgctttccatacctcttcatttaagaatttcgcaatcggactttgcacgccttcaagaccagcattaatatcgtttacttttgcccaagccaaaccttttgcaccgtagatgcctacaaattgtgtatattcatcaatttgtttacgagtaatttctgcaccatttggtactcgaatgactgcaacacggccatttggattgtttgctggctcattaaatactttaaattcaacatctttgacaatatctgctacatctaccatttctaatggattacgcaaatctggcttatccgaaccaaaacgacgcattgcttcttgccaagtcatcactgggaacttacctaaatctacaccaatggtatcaagccataagtcgtgcaccatacgttccataatttcgcggacttctggcgcagttaggaaagaagtttccacatcgatttgagtaaactcaggctgacggtctgctcgcaaatcttcatcacggaaacattttacgatttgataatagcggtcaaaaccagacatcattaaaagctgtttgaaaagctgtggtgattgcggcaatgcatagaatttgcctttatgcacacggcttggcactaaatagtcgcgcgcgccttctggcgttgctttggtaagcattggagtttcaatatcaaggaaaccattatcatccataaagcgacgcacaaagctggtgatttttgcacgggttttcaaacgctgcgccatttcaggacgacgtaaatctaaataacggtattttaaacgttgttcttcggtgttattttggttgaagtctaatggtaaaacatcagaagcattgtagatgcgtaattctttcgctaacacttccacttcgcccgtagccatatttttattgatttggttttcaggacgcgcaatcacttcacctttaatttgaatacagaattcattacgtaacccagcagccgctgtcaatgcatcttgatatttaggatcaaaacaaacttgcacaatgccatcacgatcgcgcatatcaataaaaatcaagccacctaaatcacgacggcgatgaacccaaccgcttaatgttacgtcttgtccgatattgttacggtttaatgctccgcaataatgtgtacgcatcatttcaaaatcctttgtactcttttaattatgctcaaaaatctgtcgcaattatagcggaaaaccaagagagataaaaaggttatttatgctgacaaatcaatcaaaaaagcaaagaaaagtaataaatgttcaaaataaaggcttttttgtgccatatcatcagattttttgttatattatgcggcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgctctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataatttataaatttcttctagaataacgactctttctctctgcctttaacacattatggtaaaagatactctattttctacccccattgctaaattgggggatttcatctttgacgagaacgttgctgaagtctttccagatatgattcaacgttccgtgcctggctattccaacattattacggcaatcggtatgctggcagaacgtttcgtcacggctgatagtaacgtttatgatctaggttgctcacgaggagctgccacactttctgcacgtcgaaatattcatcaacccaacgtaaaaattattggtatcgataattctcaaccgatggttgaacgttgtcgccaacatattgcggcatatcatagtgaggtacctgtagaaattctctgtgacgatattcgccacgttgaaattaaaaatgcctcaatggtcattctcaacttcaccttgcaatttttaccgcctgaagatcgcgtggcattgctcacgaagatttatgaaggattaaatccaaatggcgtattagtactttctgaaaaattccgttttgaagatactaaaattgatcatttactcattgacttgcaccaccaattcaagcgagccaatggttatagcgaattagaagtgagccaaaaacgcaccgcacttgaaaatgtgatgcgtacagattctattgagacacacaaagtgcggttaaaaaacgtaggattttcacaagtagaactttggttccaatgctttaattttggctcgatgattgcggttaaataaaacaacggtaatttgatcttcttgcttgcatacagcaattgaaatgattagtatatacttattaaatacatagtatatacgagagggtaaatatgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggatcgcttgtcacgcattgagtttaaatgccgttcttattacacataatgtaaaagaatttcagcgaattacagatcttcagtggcaagattggacaaaatagataattctgattttttattttacttatgacataatctgtttaactcaactaaaaaaggacaaaccaatgcaaattttacacactatgttacgcgtgggcgatttagatcgttcaatcaaattttatcaagatgttttaggtatgcgtttattacgcaccagtgaaaatccagaatacaaatatacgctggcttttttaggttacgaagatggcgaaagtgcggcagaaattgaattaacatacaactggggcgtagataaatatgaacatggcacagcatatggacatatcgctatcggcgtagatgatatttatgccacttgtgaagccgttcgcgcgagcggtggtaacgttactcgcgaagcagggccagtgaaaggtggatcaaccgtcattgcttttgttgaagatccagatggttataaaattgaatttatcgaaaacaaaagtactaaatctggtttaggcaactaaagtgcggtcaatttttattgtatttttaataacgtagggattcctacgttattttatttttaagagatagattatgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcagattgccaacgttctatcattgtggcgcacaatgccacttttgaccaaagttttgtgatggctgccgctgaacgtactggcgtaaagcgtaatcccttccacccttttggcatgtttgataccgcaagtttagcaggattgatgtttggtcagactgttctcgttaaagcctgtcaagccgcaaaaattccttttgatggtaaacaagcccattcagcgttatatgataccgaacgcacggcgaaattattctgctatatggtcaatcatttaaaagatttaggtggtttcccacatattgcttctgaactagaacaggaaaaaacaactgaaaaagagaccgcactttaagaaaaataaaaaactggttgcaatcgttttatttttccagtagtttaaaagcaattcttatttggagataaaaaatgaacattatccgtcgtcaccatcatcaccattcaactgaataatctttcaggtttttggtgtgcttggaagatttcttccgagctgacaggataataaaaatcttacccctcggaaggcaactttcgaggggttttgttttatttacgatataggaggcattaatttagcgttattctttattcaataaaaattttaaagtaaagtatttatcatttaatttacaaggaaaaacacaatgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaacgattataatcccccacttgggggatttttttatgactgttcaacaacttatccaacgcttagatcaaaaagttcaacaactttatcaagctcatttatccaaacgagaagaaaaaatcttcgccaaatttgaccgcactttatttagtgaaaatggacaaaatgtttccttttatctaaaagaaatcaatcaaacgctagatagaataaagacattagagtctaacgattctaatcactataattttctagctgagcgtttactcgcccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaagaagtggaaaaccgtgaaaatacggaaaacaaatgattagaaataaaaaactaattcttccgaattagttagctcgtaaaaattgatggcggaggaatagggattcgaaccctaggagggcgtaaaccctcgccggttttcaagaccggtgccttcaaccactcgaccattcctccgtgatttaacgagcgtgaataatacgttctctaataaaaaccgtcaagtagaaataatctcatttttatcaagtgattatttttaccacagcttataaaaaatgcctttcctatttatgaacggaaaggcatttttgttgaatgaatttcagtgctttttattactacaatatatcgcagaaattaaccgcacttttgtcatctaaacaattattttacgcgagagacgtattcgccagagcgggtatcaactctgataacttcgccgatttggacgaaaagcggcacttttacaactgcgcctgtgcttaatgttgcaggtttaccgccagtgcctgcggtatcgcctttaagacctgggtctgtatcgacgatttctaattcaacaaagtttggtggcgtaacagtaattggtgcgccattccataaagtcacgatacaatctgcttggtctaataaccatttttctgcatcgcctacggcttttgcatctgcagagtactgttcaaatgtttctgggtgcataaagtaccagaatgcatcgtctttgtatgaataagttaagttaagatccataacatcagctgcttcaaccgaagtgccagatttaaagtttacgtctaatactttgcctgaaattaatttacgaatacgagtacgagtgaatgcctgacctttgcctggttttacaaattcattttcaacgatgacacaaggctcgccgtcttgcataaattttagacctggtttgaaatcactggtagtatatgtagccatatttgaaatatcctaaaaatgagagatggtttgaaaagtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataagatccgataaaatacacataattttttcgccacacttttgagcttctcaattttgtggctaattaatataaataagaacaagcatcagaggcaatccagtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataattttttgggcgagtaatcgccttttttctttttaagttattttctcaaggtaggatttatgttgaaaaaaacatctcttatttttaccgcacttttactggctggctgtgcgcaaaatgcgaatgtgacaacacctcaaacgcaaaaaatgcaagtagaaaaagtggataaagccttacaaaaaggcgaagctgaccgatatttatgtcaagatgataaagttgttcgtgttgtacacgccacgcataaaaaatacaaaaaaaatttgcattatgttaccgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataatcgtgcaaagcgaacttcaacgtggttttgttttgcatcgtcgcccttatagtgaaacgagcttattggtagatttattcactgaagaaagtgggcgtttaaccgtgattgcaaaaggggcgcgtgcaaagcgttcatcttggaaatcggttttgcaacctttcacacctttattgttgcgttggacgggaaaaagcacattgaaaaccctcactaaagctgaacctgccgcaattacactgcctttacaacaaattgccctttatagtggattttatgtaaatgaattactcactcgtgttattgagtctgaaactccaaatcctgcgctttttcaacattatttaaaatgcttaactggcttggcaacggaaactaacgttgagccaacgttgcgtctttttgaatttcaacttttacaaatgctcggttacggcgtggattttctgcattgtgcggggtctggcgagccagtggatttctcaatgacataccgttatcgtgaggaaaaaggtttcgttgcgtctttagtgaaagataatctcacgttttacggcagagatttgttagcctttgaagccctcgatttttccgatgatgcggtacgtcaagcagcaaaacgcttcactcgtattgcgctgaaaccttatcttggcgataaaccgctaaaaagccgagagttattcactcaaaatattttacttttaaaataatggttcttctttataccccaaagcaaaaaacaaacaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatgggcatgctacggcaaaaaaatggcgagtaaaaagttctgaacgtttagaacctaaatgtgctcattttatgcgttgtggtggttgccaaggacagcatattcctattgaaatgcagaggaaagcgaaacaatccgcattgtttaagcggttaagtaaattacagtcagaaccgatttcatttcaacctatgatttgtggcgatgcttgggcgtatcgtcgtcgtgtgcgtttgagtttatggtttaatccaaacacaaaacaaatcgacatgggctttcgtcagaaaaataccaacgatttaatacccgttcaatcttgcgaagtagcagaacctgcaattaattatttactgcctaaattaaccgcacttttagaaaaattttccacaccgaaacagcttgggcatattgaattggtggctgccgataatggcgtcgcaatgttgttacgttacacgaaaaaccttgcggaaattgaccgcactttattgctcaaatttgctgaacaagaaaaattaatgctgtttttacaaagcgacaaaggcattgaacaaatctatggcgatgcgccttattatcaattttctgatggcataaaattacattttgatattcgtgattttattcaagtaaatagtgcattaaatgaacgtatgatcaatacagcgttggattggcttgaattgagccaacaagattgcgtgttagatttattttgcggcatgggaaattttacgcttcctcttgccaaacgcgtgaaaagtgcggtaggaattgaaggcgtttttgaaatggtacaaaaagcggcgcaaaatgccgcaagaaaccaaatcaaaaatattgaatttttccaagccgatcttgaccaatcctttgttgaacaaccttgggctaatcagtcgttcaataaaattttgcttgatcctccacgcagtggcgcagctttcgcgttaaatgctttgtgcgagctgaaagcagagaaaattttatatgtgtcttgtaatcctgcaacattagtgcgtgatgcggaaattttatgtgattttggctacaagattgaaaaaagtgcggtgatagatatgttccctcatacggggcatttggaatcgataaccttattcactacaaaataactcggttattcggtacaatatccacccaaaataaaagcgacaggaagttgcttgctcttcatcaacaagggggtattatggttgctgttcgtggttctcatttgttaaatccgcagaattttgtgattgaacaatggtgcactggcttaaaactagcagaacaaacagaaaaaagtttgatcgatgcgtggtattacgcacgtgatttaatgaatgcctatcccgatgaaatgaagaatgcgaccttaatgctgcagtctggcgtggaaatggtagaaattttgcacgaacttaatatggatgcggaaacattgcttactgccatgttgtttcctattgttgcaaataaattaacagactgggaaagtctaaaagaaaaatttggtgcgaaaattactaaattacttaaaggcgtgttggagatggataatattcgccaacttaatgccagtcattccgctaacgctctgcaagtggataatgttcgccgtatgttgttggcaatggtggacgatttccgctgcgtgatcatcaaacttgccgaacgtattactttcttgcgtgatgcagagtatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcagttatttacgtgaaaatatcaagcaagtggaagtctatggccgtccgaaacatatttacagcatttggcgcaaaatgcagaaaaagaatcttgagttcagcggtttatatgatgtaagagcggtcagaattatcgtgcaaaaattgcaagattgttacaccgcacttgggattgtgcatactcaatttaaacacttacccaaagaatttgacgattatgtcgcgaacccgaaaccgaacggttatcaatctattcatactgttgttttaggtaaaggtggcaagccaattgaagtacaaattcgaacccaacaaatgcatgatgatgcagagttaggtatggcggcacactggaaatataaagaaggcaatacaggcagtatgtctgcctatgaagaaaaaattgcgtggttgcgtaaattgttagcttggcaagatgatattacggattcaggcgaagtgctggcagagttgcgtagccaagtgtttgatgaccgtgtatatgtgtttacgccaaagggcgaagtggtggatttgccaacgggatctacaccattagattttgcttacgccattcatagtgaaattggtcatcgctgtatcggggcaaaagttgcggggcgtattgtgccatttacctatcagctacaaatgggtgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatcaatttcttgcaaagtaaattgattaaagtgactgctgaagaagcagatcaagagattttacgtcatgttgctaacaaaagtgcggtcaattctcagcagaaatctgaaaagaacaatggctatgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacgacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataaaaataggaaaatttatgtataaaacgacggggctaacccatttaatcaattccacgaaatattcattacaaggcttaaaaagtgcgtttaaaaatgaaacggcttttcgccacgaatgttttttagcctgcattttaattcctcttactttctttttaggcgaaacaaaaattgaaattatattgatgatttcttctgttttgcttgtgatggcgttagaacttttaaacagtgcggtagaggcagttgttgatcgcattggtacagaacgccacgaactttcaggacgtgcgaaagatcaaggctctgcatcggtatttattgccctttgtattgtcggtatcgtttggggcggaattttattcttctaaccctccaaaagtgcggtaagtttttaccgcatttttgatttatccaatcacgtcaaaattatttataaaaataaggaaaaatatgaccgcacttttaaaaattggtctggtgtctgtttctgatcgcgcatcagcaggcgtatatcaagatcaaggtatcccagaattacaggcttggttagaacaagcgttagtagatcctttccatttggaaacaagattaatccctgatgaacaaccgattattgaacaaaccttaaaagagctggtggatgaacaaggttgccatttagtgctgacaactggtggaactgggccagcaaaacgcgatgtaacgcctgatgcaacccttgcggtagcagatcgagaaatgccaggttttggcgaacaaatgcgtcaagtgagtttgcattttgtgcctaccgcaattttatcccgccaagtgggtgtaattcgtaaggaaagcttgattttaaatcttcctggtcagcctaaagcgattaaagaaaccttggaaggcgtgaaagataaagagggaaatgtgcttgtaaaaggcatttttagcgcagtgccttattgtttgcaactgattaacggcttatatattgataccaagcctgaaatcatcgaaagtttccgtcctaaatccgcaagacgcgaaaatctggagaaatagcatgaaaaaaatcgaagcaatgattaaaccctttaaattagacgatgtgcgagaaagtctttcagatattggtatttcaggtatgacaatcacggaagtacgcggatttggtcgccaaaaaggtcatacagaactttatcgtggtgcggaatatatggtggattttctgccgaaagtgaaattggaagtagtggttcctgatgaacttgtggatcaatgtattgaagcgattgttgaaacggcacaaacaggcaaaatcggtgacggcaaaatttttgtttatcacgttgagcgagcgatccgcattcgcacgggcgaagaaaacgaggatgcgatttagtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgtgtgagtgatttaactggattgttgcaacgtttcaatctgcctttcacgctttcgcgtgaaaccatccaagaaaattttgacccaagcatcattatgaattttgtaagccgagtattgctgaatttctctggtgtagtgagtaatgtgtttgttttagtgttggttgtgatttttatgcttgccgaagcaccaacgatgaaacataaatttgcaatggtaattagttcaacccctcatgatgcagccaaagaagaacgccatattgatcgcgttttgcaaggcgtaattggttatcttggcatcaaaagcatcacgagtttactgactggcgtcggagtgtttattttgttggaagcctgtggggttcaatatgccattttgtgggcaaccttgagtttcttgctgaattatattcccaatataggttctatcatcgcggctattccgattattgtgcaagccttattactgaatggttttggcattggctttggcgtagcaatcggtgttattgcgattaatatggttgtcggtaacattattgaacctaaaatgatggggcaacgattagggctttcaaccttagtggtgttcctttcattattgttttggggatggctgcttggaacagtgggaatgctactgtctgttcctttgacgatggcattaaaaattgccttggagtccagtcccaatacagcgaaatatgcctgtctattaggagatgtcgaagatttcaaatagattttagagataaaagtgcggtgaattttcaccgcatttttttatgataagtcttgcggatcgacgtccaaaattaaccgcactaggctgtttttttcaagttcggcttgttgatattctcttaatgctttttgcaacgtcattcttgacggatgttgcaataataactgccagcgatattgccccgcttttttgctgaacggtgcaggcattgggccaagcatttgtaatcccgtaatttgcttcgattgaaaaaaatctgcaatttggcttaagcaattttctgcaagatcagaatgtcgagcctgtgctttgaataacgcctgaaaagtaaaaggcggcaatcccattgaatggcgtaattgtaaggtttcttttgcaaaagcttggtagccatttgccaataaagtggtaagcaaaggatgatcaggataatgtgtttgtagcacaacttcaccttgtttatcggcacgtcctgcacgtccagcaacttgaatataaagttgagctaaacgttcttctgcacgaaaatccagtgaaaataatgcactatctacattcactaaggcaacgagagtaacattcggaaaatgatgtcctttcgcgagcatttgtgtgccaatcaaaatttggcttttgccttgttgaatatcttctaaataaccttccaattttcctttacgtgccgtgctatcgcggtcgattcgcgctacagaataatgaggaaatagcgttttcaaggtttcttctaattgttctgtgcctagaccagtagtaactaaatgggtagaaccgcaatcgccacattggcgaggaatagttttttgtgcgccacaataatgacaacgcaatacattttgatgctgatgataggtataaggtttttcacaatgagggcattgtgcgatccaaccacattcatggcaaagcaatacgggtgcaaagccacgacgatttaagaaaagcaacacttgattgcctttttcgagatgggctttcattcgttccaacaagggttttgataacccgttttgtatattttgatttttcaaatcaataacgaaatgacgaagtgcggtagaatttcccgctctttttgataaaactaaatgttggtatttgccgttttgtacattattaatactttctaaacttggcgtggcggagcccattaataccgcaatatttagtttttgagccagcacaatcgccaagtctcgcgcatggtaacgccaactgtcttgttgtttgtaagacgaatcgtgttcctcgtccaaaataattgcaccaagattagaaaattgcgtgaacaatgccgatctcgtgccaatcacaatggcactttgtccagagcgggcgcgatcccatacataaagccgttgcgtatcggttaaattagaatgcagtacatcaatttctacattaaaacgtgctttaaaacgttgcaccgtttgaggtgttagcccgatttcgggtacaagcactaatacttgcttacccgattttaaaatttcttcaatatactgcagataaatttctgttttacctgaaccagtcacgccatcgagcagccatacattgaaaccagaatggaagagcagttggctgaaggctaaggcttgctgcttatttaaggttaaacgattttcagcattgactattgggttattgcctaatctttgttgccagcttaggggatttgtttggatagtaatttcttcaataaaccctttggcttttaaggcagaccaaatggcagaggaaaaattattattgcctttttcaagatcagtttcagataagcattgtagggcttcagcttgctttttcgagcgttttaattcgccttgttcaagggcatttttccccgcatccgtaattcgccaaaaagtgcggtcattttttaccgcactttcgccgttacgcaatttcacaggcaaggcttgaaataacacatcgcctaatcccgcttgataataatttgctgcccagtgaagccaatcccaataaatgggcgtaaaaagtggggctaaatccaatggttgaagaatagccttgagtttatcctctggcacgtccgattttgtcggaaaatcagccacaatggcgacacgtttttgagtgccaaaaggcacaagaacacgcataccgatttgtaatgaaacatcatcggggacgaaataatcaaataagcgaggaagcggcacagccagtgccactcggacaattttcataatcaaccttgggaaaaaatttgccctattatacgagaaaaattggtataatcgccgccaatttttttcacgaacaagatttttatgacacaaacttttgccgatcaaaaacgtaaaaccgttgaaaccgcagaatttaccgaagatggccgctataagcgcaaagtccgtagttttgttctccgcacaggtcgtttgagcgaatttcaaagaaatatgatgaatgataactggggaacacttggtttagattatcaaacggaaccttttgattttgctaagatttatggcaatgataatccaattgtattagaaattggctttggaatgggaaaatcgcttgtggatatggcttttgctaatcctgacaaaaattaccttggcattgaagttcatactcctggcgttggtgcttgtattgcttatgcagtggaaaaaggcgtaacgaatttacgcgtgatttgccacgatgcaacggaaattttacgagacagtattgctgatggtgcgcttggcggtttgcagttatttttccccgatccttggcataaagcaaaacatcataaacgtcgtattgttcaaccgcactttgtgacacaagttatacaaaaattaggtaaaaatggttttatccatatggcgacagactgggaaaattatgcagagcaaatgctagaagtattaagcgcaaacaccgatttagtgaacacctcgaaaaatggcgattatattccaagaccagattttagacctttaactaaatttgaagccagaggttacaaacttggacatggtgtttgggatttatattttgtgaagaaataagcggattttaactaaacccaatacctaatttatgaatttaatataaaatacacgtttgaatataaccttaataggagaaataaaatgtctaaatcttacaatcaacgccaacgcaaaaaacttcatcttgcggaatttcaagaactgggttttcttgtaaatttccaatttgcagaaggcactgcgattgaaactgtagatgaaatcgttgatcgttttattaacgaagtgatccaaccaaatggtctagcttatgaaggtagcgggtatttacattgggaaggtttagtttgcctagaaaaaattggcaaatgcgatgaaagccaccgtgaaactgtgaaaaaatggttagaaacaaatggtttgcaacaaattgaagtaagcgaattatttgatatttggtgggaatatccagcaaaagctgaataatctaaattgaaagcagcataacaaaaattgctatgctgttttgttttaatcccttgcaaaattcattaaaccttaaattttttgatctataacaaataaagttcaaataattgacaaactacctattttgggttgttctcattcattcatcgtaaacacataatccttcatctacagaagcattcagaaatattttaaagacattatgaccgttgaaaatttacctcgcagacaatttttacgcggtaaattttcaacattgagctgtttagaaaataatcaaaaacagaattttgtgggtattagaccgccttggtctgtggaaaattctatttttgtagcacaatgtacgcgctgtggcgactgtctttctgtctgtgaaaccaatattttggtaaaggacgatgctggttttcctgaagtgcgctttgataatggcgaatgtactttttgtgggaaatgtgtagatgcctgtaaacagcctattttttatcctcgtgaccagttaccttggtcacataaaatcgacattggcgtagcttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccctgtgaatgcaataacaatgaacgatctaaaacaaaatgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaataattttaaaatcaaacgtttaacgtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaaaaaccatgtaaaaatcaaccgcactttatttctcccatcaataaaagaggaagatgaaagtgcggttaaaatctaaaaagaaaatgaagaaacccgcccttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgtgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaagggacaactgtaattcctgaaccagcagaacccgtgctcgcaccaattttagggggcggaaaataatggcaaatgcaccaaaatttgcagggaaagaggctcgagaaaaatggggctggtggtatgcaaaccgctttttgttttggcgtcgattaagccaacttagcattcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgtgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatcctattgttccaaatgatttcaaaccgatgaaaggttacggaaactaatttaagaggtctatatgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcgcatcgtttagaaatggctcaaaatgaatgggcgcgtatgaaagctaacgattctaaagaatgtcgtaattgccataatgtagatcgtatgaacttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtgattttctaaaaataggctgaaaaaataccgcacttttttcagcctattataaatttgggtagtttataaaaaaatctgcactttaattcgctgatttattcagcctttaaggtgcagattaattatattttctaaagtgcggttaatttttagattatttttagcctaagattttatctaactcttggctaacttcttctactttttgtgtaccgtctaaacggaaatattgagtattccccgctttcgcttctgcttggtaataatcaattaatgggctagtttgtttatgatatacggctaaacgatctaatacagtttctggtttatcgtctgcacgaataattaaatcttcgcctgttacatcatctttaccttccacttttggtggattataaacgatgtggtaagaacggccagacgcttggtgtacgcgacggccactcatacgttcaacaatcacttcgtctggcacatcaaattctaaaacaaagtcaattttaacacctgaatctttcagtgcatccgcttgtggaatagtacgagggaaaccatctaacaagaaaccatttgtgcagtcagcttgagcaatacgatcttttacaagggcaacggttaattcatctggcactaatttaccttcatccattaatgctttagcttgtttgccaagttcagtccccgctttgattgcagcacggaacatatcaccagttgaaatttgcgggataccaaatttgttcataataaattgtgcttgagtgcctttacctgcacccggtgcacctaaaagaataattttcataaaaaatctccattaatacaaaacgtgattaagatactgataaagcatagtgcggtcaaattttttataatttttaccgcacttttatactgagctggtcttattattttcttgcttcaaaggtgctacccaaaataaacaaagcatgccgggaatcgctaaaaataaacaaaaccaaaaatactgataataccccactgctcccacaacataaccagaaagtatacctaaaactttacttggcaaagctgaaaggcttgtaaaaagtgcaagctgtgttgcagtataaagaggattactctcacgtgccataaaagccacaaaagctgcggtaccaagtccaacgccgatatattctgcggcaatcacaacacctagtttccataactcggcagatgtaataacatcaaaatgaccgaaagcagacaaccaaataaacccaccaattgttaccatttgtacaagcccaaatagccacaatgcacggttaatacccagttttagcattatcataccaccagcaagcccagataaaatgcttgaccaaagtgcgttactttttacaacaatagcaatatcctctttgctaaatcccatgtcataaataaatttggtttgtaacgttgtggcaaaagaatccccgaacttatacaaaaacaaaaatagtaaaaaaccgatagcctgaatgacgcccttacgctggaaaaattcttgtaatggaatccaaaatgcttgatagaacggctgattagtttgctgcacgttgattttcggctcttttgctaaaaataatgtcatgaagatgcctgctaacatacaaagtgcggtccataaaaagacggtttcccaaggataaatcgccgccaaatatagcgataatccccctggaattaatcccgcaattcgataagcattaatatgaatagtgtttcctaaacctaattcatgatcactcaaaatttcacgacgatacgcatccaacacgatatcttgtgtagctgaaaaaaaggcgataagcaacgcaatatttgctactgtacccagttgtgtgagcggatcaaacaggctaatgatgtaaagtaaaatcaataatgccacttgtgaaagcaacatccagctacgacgacgccctaaaaaactcgggaaataacgatctaataatggtgcccacaaaaatttcaatccataaggcaacatcacacccgttactgcaccaataagctcaattgaaagatgtttatctgtcagccaaacaggcaacatttgcgacaatacaaataatggcaaaccagaattaaaacctgtgaaggcgcaaattaacatcttgcgcgtaaaaatttgagaagaaagggaatttgacataaagtgcggttaattttagttgtattttagaaatttcgcctttcaattaaaggatttttgtaaaaattaggggatttttaatcattcccctaatgtttagcattcttcttcctaaaaaagaaaaacaaatattagagaatattaatctctatacccttttggattatttttctgccagttccacgtgtcttgcatcattttttcaagaccacgttctgccacccaaccaagctcttttgcagctaaactaggatcagaatagcaagtagcaatatcgccagcgcggcgttctacaagtttatatgcaattgtaatattgttggctttttcaaaggcttttaccatatctaatacggaataaccatggcccgtaccaaggttataaatatgtaagccagcgtcattttcatgacgttgaagcgcttttaaatgccccacagctaaatccactacatgaatataatcacgcacacctgttccatcatgagtgtcgtaatcactaccaaatacagaaagttgtgctaatttaccgatagcaacttggctaatataaggtaataaattatttggaataccatttggatcttcaccaatcaagccactttcatgcgccccaactggattaaaataacgcaagatagtcatgctaaattttggttccgcttttgctgtatcgcataaaatctgctcaaccatatatttagatgtaccataaggattggttgtaccgccgacctcacaatcctctgtaattggaataatttttggatcgccgtaaaccgttgcagatgagctaaatacaaagttccaaacacccgcttttttcatttcttgaattaatacaagggtgccagcgacattgttcatgtaatattctgtcggcttttgaacactttcccctacggcttttaaccctgcaaagtgaataaccgagttaatctcattttctgcaaaaattttttgtaacaaagcacgatctaaaatatcgccttcataaaactttgcttctttgcctgtaatttgttttacacgctcaagggattttggcgatgaattgcaaagattatctaataccaccacctctttgccagcatttaataattctacaactgtgtgagaaccgatataaccggcgccacctgtcactaaaatggccataatgatttccttgttaattattgagactaaaaaattatatcactattttgtgtggtaagaatggtgattttcaataaaataaaaaacctgttgctaaaaagtattgttgtagcgagtgagataacctctcatatttagggctatgtccattagttgtgtgatataaggttatctaatcccattttcttgattttaaggcgtgttttatatcattaggtaaacgtaatatatcccagaacaaccgaaaaatcagattttggtaaattcttggtttggaatatataccaatttttttatatacaaacttcggcggaattaaaatatcttgtgtgtaatttttcttttcttctggaataaaagcaattgggttattcagtggtgataaaggaaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctttttgatgatgaaatgcgtaaggattccctttttcttgataaaaatcaatacctgttaaataaagatctttataacccattgcagtcgccactgcacacatataaacgcctgatgtaatcctcttattctcatataattcgtgatattgtaaatgagcattaaaagctcgtagttttttcaaatagcaatgaccaagatcaatttgtggcagtaatttttctaaatgctggattttctttaatgttgaatcccctaaattcagaaaagatgctaagataatatcagcatattcatatttatattcattatttttaattaattgcataaacgtatagtattgttcaaaaattacagaacaattaaaaaataccttttttattttcttgccaagaaaataatgatcttcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattgacatattgtaccgttcattgaataaaatagaagttatccctaaaaaataataaacattatatagatttatagaactttttactaaacgttgattataccttcctaaaattattatctaatatcagttgtactatctccgttgtatcttagcaagaaaaatttaaaaatgcttttcttgttccattcggatagaaacctaatcgcttgttttttctaccaaacaagcgtagacttaccaacaatttttagtcggggtgccgaaaggctgagatgatacccgtgaacctgaaacagttagcactgacgtaggaaactaatatgccaaaaaatccattttcttttcattccatttcttatcctttcttttttattacgcattccctttaatcattgaggcgagcaatggtgcgtattcaagatttgagtcttgcctttaatgggcaaacgttatttgagcatcttaatttaaccctgttgccgaacgaatgggtgagcttattgggcagttcaggcgtgggaaaatcgacacttttgcgactactggcgggcattgaaacgcaaggtgtggtgcaggggaaaatcctatttgaaccgaaaattcgtattgcgtggttgcctcaaaaagagaccctttatccgtggttgtcaattgtcgataacgtgcagttgcaagcggtcttatttgggcgaaaatctgcaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggcggatttgattttgcttgatgagcctttttccgctcttgatgccatcagtcgccatcaacttcaagatttagcctttgaactgctagaagataaatcagtgctgctcgtgacccacgatccgcaagaggcattacggctaagtcagcgtatttttgtgttgcgttcgcctgaatctcatcaaacagcattatcggcggtgattctgcccgaaggtaacgcccctcgtgagttgcatcaagccaatttatgggcgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtagggcagcagttattcacacacgctgaactgctttggcagcatacgcaagtcacgttgttagaaatttgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggcagcttgttatgatggactacgcaacaccccacaagcgtggctcgatttggcgaaaacctttaacatttcccccttgcgtttattgcttaaagtgcgattacctgcggctttgcctgcttttgcttcgggcttgcgaattgccgtttcggtcgccccgattggtgcggtggtaggtgaatgggtcggttcatctgaaggcttggggtatttgatgattcacgccaatgcccgaatgcaagtcgatttaatgtttgccgccttactgattttagtgtcaatttcactctgtttatatttcagcattgattggctattacaccgttttatttggtctgtttaacttttcattaaaggagaaaaaatgaagacaatcatccgttatttcagctttgtaatggggctaatgctcacgcttcctagctttgcaaaagagaaaatcagcgtaatgctagattggtatgtaaaccccgatcatgcagccatcattgtggctcaacaaaaaggcttttttgaaaaaaataacttggaggttgaaattatcgaacctgctgatcctgcattaccgccgaaattagcggcggcaggaaaagttgatttagccgtgagttatcagcctcagctttatcaacaagtggcagaaggcttacctttagtacgagtggggtcactgatttcaaatccattaaatagcgtagtggtactaaaaaagagcaatttggaaacccttgctgatttaaaaggtaaaaaagtggggtattctgtcagcggttttgaagatggattgcttgacaccatgcttcattctattggtttaagcaataaagatgtggaattagtgaatgtaaattggtcgctttcgccttctcttttaactggacaagtggatgctgtgattggtgcatttcgtaattttgaactcaatcagcttgctttagaaaagcaagaaggcgtcgcattcttccctgagcaatatggcgtgcctgcttatgatgaattgattttagttgccaataaaaacagcgtaacagataaaaaaacatccgcctttttgaccgcacttgaacaagccacaagctatctgcaagctcaccccaatgaagcgtggcaagcctttgtcagctataaaccgaacgaactcaacacgccattaaatcaactggcgtggaaagacacgctccccttcttagccaataaacctcgtcaattagacgctaaacgttatcaacaaatggcagaatttatgcaacaaaaaggcttaattccaaaagccttagcgttgaaagaatatgcggtagaaattgaataaggaaaaaagatgattgaacaactcattcaacaagcccagccttattggcaacaatatattgaacacgaatttgtgcaacagctcgcaaaaggtacgctgccaaaagcttgttttcagcattatttaaagcaagattatctctatctttttcattacagccgagcttttgccttgggcgtgtataaagcaaaaaatttcgctgaaatggaaatacctcgcaaaaccttagagatactctgccaagaaattcaactacatttaaattattgccgtgagtggggaattagtgagcaagagatttttgctactcaagaaagtcccgcttgtattgcttatacccgctatttgcttgattgcggcatgacgggcagtttggctgagctttatgcagctgtgactccttgtgctttgggttatgctcaagttgctcgttacattactcagcattatcctcgcttaccgaacaacccttatcaaacgtggattgacacttatgcgagcgaggaatttcaacaagccgcccaagaaaccgttgattttcttaccgcactttgtaaaccgctaaactcaagccagcttaccgagattcaacagatttttaccaccgccactagaatggaaattgcgttttggcaaatggggttggatttggcttaggtttagtctcagactaatgactttatttttccacaaacggataaatttattgtgattatataacccctctttgagaaagaggggggaaggaaaattatcttgttctaattttgctataagctaatgctataacaaaaaatgcagcttgcagaagaatgatacaagcacctgttgaggcatcaaaatgatagctcaatattacgccaattaggcttgatgcaatggaacttgcaatagcaacccataacattttatcaaaagatttggtaagcgtaagtgcggtaattcctggtgcaattaacattgccaccaccaaaataacacctaccacttgcatcgtgcttacaatggttaaagcaagtaatattagcaagccataatgtaaaacttttggagaaagtcctgcaacacgggcgtgacttggatcaaaacaataaagcagaaagtctttacgtttgaaaacaatcaaacaaaaaattatcgcagaaatgaccgcactttgaatcagctcttgatgacttacacccaacacattaccaaacaaaatatgggttaaatgctgttctgtttgaattttggtaaacataaccaaaccaatagcaaacattccagaaaatacaatacccattgctgtatcttcttttatacggctattttctttcaaatatcccacaccaagcgaacaaaaaatacctgagaaaaatgcaccaatggctaaaggaattcctgccaaataagcaagtacaataccaggtaatacagcgtgagaaattgcatcacccattaatgaccaacctttcaagactaaatagcaagaaagtaacgcacagataatcgaaacaatcaatgcggtcaataaggcattttgcataaactcaaattgtagcggttctaaaagccaatcaaacattttctaccgcctttttattacgagttaataagccatattttggtgaaaataagaaagcgactaaaaacaataatgtttgcaatgtcacaatcacaccgcctgtggcaccatctaaataatagctaatataaacaccaacaaaacttgtcaccgctcctaaaataatggcgatgattgacaaggttttgaatttatccgtcagtaaatatgctgttgcaccaggggtaataaccatcgcaatcactaaaatcgcccccacagtttgtaatgcagcgaccacacaagcacttaataaagtaaaaaataaaactttataaaataatggcgaaagccctaccgttcttgcttgtgtttcatcgaaaaaaatcagtagtaaatctttccaaaataataaaagtaatactaaacaaacaccgataataattgcgacttggtaaatatcgtcatcggcaatgcctaaaatattacctaaaatgatattttgcacatttactgcggttggatttaaagaaacgattaacaaacctaatgcaaagaaagtactgaaaataaaacctatcacagcatcttctttcagtttagaaatggatttaatccaaagaatggaaagtgcggctaaaattccggcaaaaaatgcaccaagtgcgtaaggcaacgcaaaagcataggcaattgcaacaccgggcacgacagaatgggaaagcgcatcgccaattagagaccagcctttaagcattaaatatgaagacaaaaaagcacaaatgccacccactgcggtactcaaaatcatcgccttgagcatataatcataggaaaaaggttcgagcaataaatctaacattacctaatccctcttatttttaaccgcacttttataaggacaatcttcaaaatgacaattttgtgttgttggcgcaggtggatcttgcttagtttcgccatagaatacaacggctttttcatcatctgttaagacagtaacagaacgtttatcttcatcattatgtaaattttcgcccaataatttaatatgacgtaataccccaccaaatacaatttccaaattatgttggttaaaggtgttttctgtttttcctgcggcgataactgtgcgattaatcattaccacttgatcacaaaaatcaggaacagaacctaagttatgggttgaaacaagaataagatgaccttcttctcgaagctgttgaagaagatcaacaatggcattttcagttttcacatcaacgccagtaaaaggttcatctaataaaataatgggactttgttgtgctaaagcgcgggctaaaaacacgcgttttttctgcccgccagataactcgccaatttgacgatgcgcaagatgttcaatatttactcgctgcatcgcctcttgaactttttgtttatcaatcgctttggggatacgaagaaaattcatatacccataacgtcccatcatcacgacatcatacactgatactggaaattgccagtccacttcttctgattgtggtacataagcaaccaaattacgtttcagtgcttgggaaattggcaaatcacaaagtttaatttcgccttgttgtggctttacaagccccattatgcttttaaataatgtggacttgccacttccattcacgccaactaacgcacaaatagttccactattgagtgagaacgtcatattgtgaatagcagtatgaccattgttgtaacgaacagttacatcattaacccaaattgatgtcgagaaagagtccattattttccgaatcctttaacaatggttgatacagtgacgttaagcaaatcaatataagttggcacagggccgtttttcgcagaaagtgaatcaacgtacaatacgccaccgtattttgcaccactttctttagctacttgttgtgcaggtttcgctgaaattgtactttcactaaacacaactggaatattgtttttacgaactaaatcaatcactttacgcacttgttgtggtgtgccttgttgttctgcattgattggccataaataaccttcttttaagttgtaatctttcgccaaataactgaaagcaccttcacttgttacaagccagcgttgcgcttctggaatttgtgctaattttgcacgaagcggttcatcaagttgtttaattttttgagcatagtcagcggcatttttttcatacacagctgcattttgtggatcgtatttcactaacgcattcttaatattttcaatataaattaaagcattagatggcgacatccaagcgtgtggattaggcgcatctttatacgggccttcataaatagataatggttgaataccttctgttactaccacagcaggtttatctttaacattttggaagaaacgctcaaaccaacgttccaaatttaagccgttccataaaattaaatcggcagattgtgcttttacaatgtcttttggcgttggttcatattcgtgaatttcagcacctggtttggtaatagattccactgttgctgcattgcctgccacattttgcgcaatatcttgaatcacggtaaaagtggttacgactttaaattttgcgttagcttgcattgcaaataaaccaagtgcaagtgcggtcataattttgaatgaatttcgcataagatgtccttatttaaaaaagatagattgaatgcctgaataatcgttcaacagcacaacaattattcatcggaaataatagtactactttttatgttgttttggaatggaaatgattatcaaaataataggtttatttataattatttcgtacaaaatgtattgcttttatgaaaaaagcataaaacaaagaattttcttaatcatacaagcaataaaggtattttctgtcattagaatgactttttatcaaattaagtctagaatattgaaattattatagatttaccatttgaggataagatatgaaaaaagcattttggttagtattaagttcagcaatagtcttggctgcttgtgatgataaacctaaaatgacggagcaaactaaaacaactgaccaagcgaaaatggctgcagaacaacctgatcaaaagcccgtattgatcaattataaacaaattgccttagacaaatcccagcaagcgattgatacagcgaaagtcgctcaagacaaatcagttcaagctaatgaagccgtgaaagtagcaatgcaaaaacaacaagaggctgaaattgcgctaagtcaaggtggcgaagaggctgaaaaattgtctaaacaaaaaatggacgaatctaatgcagctgcagaattagctttaaaattgtcggaagaatccaaagctgcttctgcactttcaatccaactttccaaagaagcggaagatgcggctaataaggcgaatcaacaagctcaagctgagaaatagcgtaagatttattcttctaatttctatttaaatcaactaaaaaacgcgagataaaacaactcttatctcgcgttttttgtgtttatgaacattatcttgataatttctgaattagcgtattaaatcccacttcatcatagccatcttcatattgagcttctccagctacatcacgaattgttcttccatttaatgctgtgcagccgaatttttctaatttgcttttagtaaaactagaacgatacgcagaggaagtgttatttaaactaattacgccaatagttgcatttttgcataggtgtttattaatgaaaacgagattataaccagattctcgaatgtagcccgttttattcactgccgcatcaaagatttcatcacgcactaacttattagtatttttaatataaagtttatgtttcccagcttgaatataagttgcactaagattagataaaagtttaatgtccgatttatttaatgaatatttagcgagtttaaccaaatccatcgggctggaaatattgtagctagataaccctgaactatcgtgaaaacgagtagaatacataccaagttgatgggctttttcgttcattttattaataaattggcgacgacttattcccgctgcacgagaaagcgcgtgggcagcatagttatcagaatggacaagcattgctttcaataattcgttacaagagataggaatatttttaggtaattttgttcctgtacctttaattcgatccgtatcctcttttgtgattgcgattcgacaattaggatttttattattctctaaaaatacattagccgtcattaattttgttacagaggcaataggctgaatactatcaggcgcatagctttccaatactcgattatgggtaaaatcatacacaacataagactgtgccagcaaaaaagaaggacacaaagataaaataaataaagcttttttaaacattattggacaccttaaaaaatgagctcacattttaccgcactttttacgctgtaattggaaatatttgcgatctagatcgcaaaaaagtgcggtaagattttccatcgtttttcaattccgctagattatgcaatgacaaatctgtacaatcgccgttcattttttaattgcgaatttttcgttgtgagtttttgataaaacacctgcacaacgctatcgccacaatgtgtaataacgaggctaaaatgtcagaattattgtctgtgcaatcagatgcacccgctaaaaaaattaatctaatggatttaacgcgccaacaaatgcgcgaattttttaaagaactcggcgaaaaaccattccgagcagatcagttagtaaaatggatttatcattttggcgaagataacttcgacaatatgacaaacattaataaaaaattacgtgaaaaacttaaagcggttgcagaaattaaagccccagaagttgccgttgaacagcgttcagccgatggcacgataaaatgggcaatgcaagtgggcgagcagcaagttgaaactgtgtatattcccgaagcagatcgcgcgacgctttgtgtatcttcccaagttggctgtgccttagcttgtacattttgttcaacagcacaacaaggatttaatcgcaatttaacggtttcagaaattatcggtcaagtatggcgagcctctaaaattattggtaactttggcgtaactggcgttagacccattacaaatgtggtaatgatgggaatgggcgaacccttattaaatgtcgcaaacgttgttcctgcaatggaaattatgttagatgactttgcttacggtttatcaaaacgtcgtgtcactttatcaacttctggggttgtgccagcactagataatttgagcaaaatgatcgatgtggcactggcaatttcattacatgcaccaaatgatgaattacgtgatgaaattgtgccaatcaacaaaaaatataatatcaaaaccttgattgactcagtaaatcgttatttaaatgtatcaaatgcaaaccacggcaaagtgacgattgagtatgtgatgctcgatcatgtaaatgatggcattgaacacgctcatcaacttgcagaagtattaaaaaatacaccttgtaaaattaatttaattccgtggaatccgttcccagaggcaccttatgcaaaaagctcgaatacgcgtatcgaccgcttccaaaaaacattaatggaatatggctttaccgtgattatccgtaaaacccgtggcgatgatattgatgcggcttgcggacagctagctggagatgtgatcgatcgtactaaacgtacggcaatgaaacgccaatttggacaaaatattggggtaacagaagttaattaatattctaggcatgtgaattaatcaagttcacatgccctatgttttcatacaaattaaagcatattaaatatttcgactgcccctgttaaaaggagaaaaatgcaaacaataagtaaacaactaagtgcggttattttccctttcattttttctgcctgcgtttcacaatctgcgtctagcttagatcatcaagctgccgccaaagcgcgagtggaactcgctttgagctatcttcagcaaaataatcctcaactggctaaaatcaatttagacaaagcacttcaacacgataaaaattactatctcgtacattcagcacttgcacattattatcaacaacaagggcaaatagaaaatgcctttcgtgagtatgaaatagccgtaaaacttaatcataaacaaggcgatgtacataataattttggtacgtttctatgtagtcaaaagaaatttgagcaagcccagcaacaatttgaattagcccttaattcgccgaattattatcatcaagcagatacatttgaaaatatcgcgctttgtgcttattccgcgaaaaaaatggatatttatcagcaaacattagaaaaattacgtcaaatcaatggaaaacgtgcggaaaaattcaatagtctaaaataaagcattgccaaatcaagtattggactttaaaatttagcccttatttaccgcctaattatttgattaactttatgaatccaactactgagcaagtgctttctcctggtgagatttttcgtcaaacacgcgaagccttaaatctttctcttgaagatgtcgctaaagaaatcacgctacgcccttctatattagagcaacttgaaaataatgaatttattcaaaaatcaacgccttctatatttgtcaaaggttatgttcgcagctatgcaaaattcttacgtttgccagattctgtgtgggaaaatattgtttttgctgaaaccgaaaaaaatgatttagggaaaaatgcacgttcaacccgtgccgttaatcaatattcttctcacaatcgttggatcgggcgtttaaccgcaatagtattcgtgatggtaattggtatgactgggctttggtggtggcaaagttatcaacaaaatactcaagaacgcgatgatttagtgcaaagctatgttgcctctaccgaaaacaatcagcccaccaccgctcttgtgacaacagaagaaactaataaatctgcaccagaaacagcagcaccagtctcacaaccagtagaaataacaaataatctgttaccagaaatagcacaagaaaatagcgtttcacaacccaaaaacgatgaaaaatcagtttcagacattcaaagtgcggtcgaaaatccaagtatttctccaacgttacctatagcaaaaggcgatttagtgattgaaatactagcaaatagcagttggattagtgtaaaagataacgctcgccacgtattagcacaaaaagaatataaacaaggcgaaatattaacctttaatggcaatgaattttcattaattgtaggcgcaccaagcaatgtgcgtatcacttacaaaggcgagaattatcctctcaaagtggatggtcgcgtagcaaaattcaagctttcacaaccttaggaaaaataatgtcagcttttcagccaactattaagcgtcgtgaatcgacaaaaatttatgtgggaaatgtaccaattggtggggatgcaccgattgccgtgcaatcaatgacaaatactcgcaccactgatgtggaagcgacagttgctcaaattaaatcattagaacgtgttggtgcagatattgttcgtgtatctgttccaacaatggatgctgcggaagcatttaaacaaattaaacaacaagtgaatgtcccgctcgtagcagatattcattttgactatcgtattgcgttaaaagtcgcagaatatggagtggattgtttacgtatcaatcctggcaacattggtcgtgaagatcgcgtccgtgccgttgttgattgtgcgcaagacaaaaatattccgattcgtattggtgtaaatgcaggctctttagaaaaagatttgcaagaaaaatatggcgaaccaacgccagaagccttgttagaatccgcattgcgtcatgtagaaattctagatcgtcttaacttcgatcagtttaaagtgagcgtaaaagcctccgatgtattcttagcggttgaatcttatcgtttactggctaaagcaattaaacagcctttacatttaggcattacagaagcaggtggcgcacgcgctggcgcagtaaaatctgcggtgggtttaggaatgttattagctgagggcattggtgatacactgcgcatctctttggcggcagatcccatagaggaaatcaaagtcggttttgatattttgaaatctttacggattcgttcaagaggaattaactttattgcttgcccaacctgttctcgccaagaatttgatgtaatcggtacagtaaatgcgctagaacaacgccttgaagatattattacaccaatggatgtatctattatcggttgtgtagtgaatggtcctggcgaggcactcatctccgatctcggcgtaacgggcggtaacaaaaaaagcggttattatcttgacggcgaacgccaaaaagagcgttttgataacgaagatatagtgaaccaattagaagcaaaaattcgtgcgaaagtcgcacgacaagatccaaaaaacagaattatttaaggaaagcgcgtggcaaaaacaattcaagcaattcgtggtatgaacgattgcgccccaacagaatctccattatggcaatggattgaagcacaagtacgcaatgtattaaatagttatggctattcggaagtgcgtatgccaattgtagaaagtacgccattgtttgcgcgtgcaatcggcgaagtaactgatgttgtctcaaaagaaatgtacaccttttgggataacgatgaacaattaaccttacgccctgaaggcacagcaggttgtgtgcgagcagccattgaacacggttggatctataataatgaacaacgcttatggtatatcgggccaatgttccgtcacgaacgtccacaaaaagggcgttaccgtcaattccatcaagtaggtgttgaggtattcggtattgcgaatccagaaatcgatgccgaattaatcatgcttacctatcgtttatggaaagcgttaggtatcgatcaacatgttacacttcaacttaactcaattggttctttagaagctcgagcaaattatcgttcagctttagttggattcttagaaaaccatcaagatttaatgagcgatgaagaaaaagagcgtttagtaagaaatccgcttcgtattttggatacaaaaaatccagaattacaaaaagtattagataacgcgcctaaattacttgattatttagatgatgaaagccgtgcgcattttgaacaattatgttcattattagatgctgttggtattcaatatgaaattaatcctaaactcgttcgtggtttagattattacaacaaaactgtatttgaatgggtaacctccgctcttggtgcacaaggtaccgtgtgtggtggcggtcgttatgacggtttagtggaacaacttggcggacacgcaacgccaagtatcggatttgcgatgggattagagcgtttagtcttgttggtacaagaagttaatccaaatgttcctacgaaaagtgcggtggatatttatgttgtttatcaaggcgaaggcgcaacattagtcgcttttgaattagcggaaaaagtacgctcggaattaccgcacttaaataccatgttgcactgctctggcggtaattttaaaaaacaatttaaacgtgcagataaatctggtgcaacattggcattagttatcggcgaaagcgaagtacaaaataaacaagtcgttgttaaacacttacaaggtggcacagatcagcaaaccttagatttagtgaatataatcgactatcttcaaactcaattttaatttaaaaggggaaaaacatggcttattccattgaagaagaacaagagattaaccagttaaaagactggtggaaagagaatggcaaaacaattattgtcgcttttatcttaggtgtgggtggtatgtttggatggcgttattggcaatcgcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactcaaaaacaagatttttcagcagcagaagcaaatttaaaccaagcattaacccaatctcaagatgaagtattaacatctattgttgcattacgtctcagtgcagtacaatttcaattgggtcaattagacaatgctttaaccaccttaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaacctttaaaaaataatacccgcatcaaagtgcgggtattttttcaatcaaatttctgattattcaaattcatccagccattttaataaaatagcctcaagaattgattcatttgatttattcggatcgtcatcaaaatcttcaagttcacaaatccatttatgtaaatcagtaaaacgaactgtttttggatctaaatctggattacgatcgtaaagttcttctgcaattaattgggcgtctgtccatttcattagtgagccgcctcatttgcgtgattaaggttatattttggaatttctaccacaagatcttcatttcccacgacgcattgacaagataaacggctatccatttctaatccccaagccttatctagcatatcttcttcttgatcactcgtttcatttaaagaatcaaacccctcacgaacaatcacgtggcaagttgtacaagcacaagaaccatcacaagcgtgatgaatttctactcccgcattgtgagcaacttctaataagttatctcctgttgcagcatcaacgaccataccttcaggacaaaatcttcattaggtaaaaaaatcacttttggcataatactttcctcaaaattatttaatatctgactgcagttttacggattttcaatgtctgacagatttttacctgtcaaagctttattaattgatgcattcattcggcgagcagcaaattcttgggtagcagtgtctaaggctttaattccttgcgcaattgcatcgcgatctgaaccttgttttacatccattaattgttttaacacagtttcaatatgatgaaattcatctgtgctaagcaattcagccccatctgcttgtagtgcaacaatcacgctttcaataacacgatctgcttccacacgctgctctgccaattcacgtgcttgtaaatcttcttgtgcattatcaaaagaagatttaatcattgcggttacttcttcatcagttaatccataagatggtttaatttgtattgaagcctgtacttttgtcgatttttccatcgctgtaacgcttaataaaccatctgcatccacttgataagtcactctaatatgggctgcccccgccgccattggcggaatacctcgtagagtaaagcgtcctaaagaacgacaatcatcgactagctctcgttcgccttgtagcacatgaacactcattgccgtttgcccatctttaaaagtagtaaactcttgcgcacgagccacaggaattgttgtattacgtggaataattttttccactaatccgcccatcgtctcaatgcctaaggaaagcgggacaacatcaagtaataacatatcagaatcagttttattcccgactaaaatatctgcttgaattgcagcaccaagtgccacaactttatcaggatcgattgaggttaatggtgttttaccaaaaaactcgccaacttgttctcttacataaggcacgcgagttgaaccaccaaccattactacggcttgtacttcttcggattccacattggcatctttcaatgcccgacgacaagttagcaatgaacgttttacaagcggataaattaattcattgaattgttcccgcgaaatctctactgaaaaatcttgccaagaaataaccgcacttttttcattagtcaaggtaattttagcttggttggcaagggttattagctcacgctgttgatttgctgtttgtggttttagcttagtttgttctattacccaatctgcaattaaatgatcaaaatcatctccacctaatgcagtgtctccccccgttgctaaaacttcaaagataccttttgataaacgtaaaattgaaatatcaaatgtgccaccgcctaaatcataaaccgcaataatgccttcttgcccactatccaatccataagcaagtgcagctgcagtaggttcattcaataaacgtaatacatttagcccagctaaacgcgcagcatctttagtgctttgacgttgagcatcatcgaaataagctggaactgtaatcacaaccccagaaagctcacctccaaggcgttgttctgcaatgtgatttaagcgcgataaaatatctgaagacacttcaattggacttttaggcccctgtgccgtaataattaaaggtaatccattttcactcgccacaaattcataaggcaaactagaataacgagactgaacatcaggaaggctgcgaccaattaagcgttttactgaaatcaccgtattttttggatcaagtgaggcttgctcaaaggcttctaaaccaactttcttctcttcaacgccataatgaacaactgacggcacaagactgcgttcttgttcatcattaagaatcacggattgcccactacgcacggatgcaaccaaagaattggttgttcccaaatcaatcccaacggctaaacgatgttgatgcggtgccgcagcttgtcctggttctgcaatttgtaataatgccatatgctatttttctactagttatgcgacggaatacgccaaatcaaatttatttttttctgcaaagtttgcttggtaatgggtttcaatattgacttcctgtttttgacgttcatcaattgctatttttctgtcttggtttaaatcaggcgtaaatacaaaaacttggttaccatctaattgttttacatcatcttgccaatttttccaaaatagcccttgataaaaggcctctacatcgccattcaatgcccaagctaaaaattctgtgtaagtaaaatttaaattatgccaagtaagatcttttgatgaatagtaataaatttttccaatattattgcctaacgaaccaccatttaacgcaaaataaccaccaatcacatcatctgcaactaataaatattttggtttttcgcctgactcactaaaagatttactgaaattccaatccatcaagccacgcggtaatttaaaacttccagaacctaaaatacgtaaccaaccataatgaattaaaattccacctgtttcatagattactgcacccattggcgaggatgttggcatttgcatagtaaaaagctcacgctccgcactggattgatcttttttaattacttcacaatgattgcgagcgttatcaatccattgggaaagggttatccaagcagaatgttctggactagtgagctgttcaagagtttgcatagtgttatttattcacatctcgtaggggcaaattacatttgcccccagatttaatctaattcaaaaattcgttcttccacacgttcaatttcttcagaaagtttatgggtaaaacgtaatttatcacagtattgagatgctctcgcccattgttgagatttcaaactctcaaaaagtgcggtcaataatgattgagtttcttgtttaatttctttcgcaaaaacatttaatgctctttcatcttgctggctttcaacatcttctaattgttcgcgccattgtaattgttgcattaaaaacgccacatcttgcgtgcttttttgttcaagatctaactgctcaccagtattaagagcaatgatcgcttcagctcgcaaaattgggtcttttaacgtttttaaggcatcattcacttcggtagatttttgcatcgcaacacgttgctctaaagcactacttgagacaaaattatctggatgtagggccttttgtaattttaaataacgtgcatttagtactttttcatccagctgaaaatcaactggcaaatcaaaaatttgaaaaggattgaacatcagattattaccttaaacgtggaaactttcgccacaaccacaagattcttttacatttggattattatatttaaagccttcatttaggccttcttttacataatccagctcaatgccattgagataaacgagactttttggatcgacaataatattaacaccgtgctgctcaaaaacttgatcttcggaatttaaaacatctacaaactcaagtacataagctaagcctgaacaacctgatgttttcacacctaaacgtaatccaatacctttaccacgattatccaaaaaggctttcactcgctgagctgctttttctgttaatgtaatacccatctatcccccaaacaccgctaaaaatgcggtcaaaattgaccgcactttttcacatgattagccttgttttgctttataatcagcaattgctgctttaattgcatcttctgctaaaatagagcaatgcactttcactggcggcaattctaattcttcagcaatttggctatttttaattgccccagcttcttctaaagatttaccttttacccactcagtaattaatgaactagatgcaatcgcagaaccacagccgtaagttttgaattttgcatcttcaataatgccattatcatctaccttgatttgtagttgcataacatcaccacaagctggcgcaccgaccattccagtaccaacattgctatcttttttatccaatgatcccacattacgtggattttcataatgatcaattactttttcgctataagccattttaactttccttttttcaattctagtaaatgccattgtcagataatggcaactaaatattagtgagctgaccactcaatggtatttaaatcaataccttctttaaacatatcccataatggcgataatgcacgaagtttttctaccgcacccttcattaaattaattgtgtaatcaatttcttcttcagtagtataacgacctaatgtgaaacgaattgaactgtgcgccaattcatcatttaagccaagtgcgcgcaatacataagatggctctaagctagcagatgtacaagcagaaccagaagagacagcaatatcgcgcaacgccatcattaaggactctccctcaacatagttaaaactaatatttaaattgctatctaaacgatgttccattgaaccatttacataagtttcttcaatatcttttaagccattatataaacgatcacgaagtgcttttaaacgcggcatttctgatgccatttcttcttttgcaattcgatatgcctctcccattcctacgatttgatgaacaggtaatgtacctgaacgcatgccacgttcgtgaccaccaccatgaataatcgcctctaaacgtatgcgaggtttacgacgaacatacaatgcgccaacaccttttggcccgtaaagtttatggctagacatcgacattaaatcaacagctaattcttccaaattaatttcaactttaccaacactttgagttgcatccacatggaaaattgttttatttgcacgacaaagttcgccaatagctttaatatcttgtaacacaccaatttcattattagcgtgcataattgaagctagaattgtatctggacgaagcgcagctttgaatttttctaaatcaattaaaccatcagcttctggagacaaataagtgacttcaaaaccttctctttctaattgacggcaagtatctaacactgctttatgttcagttttacaggtaataatgtgtttacctttagtttgatagaaatgcgccgcacctttaattgcgaggttgtcagattctgtcgcaccagaagtaaagacaatttcacgagaatctgagccaatgagatcagcgatttgattacgcgcaatatcaacagcttcttctgcttgccaaccaaatttatgtgagcgagaggctggattgccaaatgtgccatcgatggttagaaacgccatcatttttttcgcaacacgttcatcgactggacaggtcgctgcgtagtctaaataaataggtaatttcattttcactcctaaattatgctaaatataaccgcacttttttattaaaaaatatactgcttatcctttttattgattaactaataaattactaaaatcacgatgagattgacgttttacattacgcttatttaccagctctgctaacgtaatctcatttaaaaaactttcaatacgtaaacttaaatcttcccaaagttcgtgagttaaacattccacaccatttttacaattttcacgccccagacatttcgttacgtgaatattttcatttactgccgcaataatcattcctacagaaatttgttcacttggtagccctaactgataaccacctcctggcccgcgaacacttttgactaaaccgtctttacgtaatttagcaaaaagttgctctaaataagataaggaaatatgttggcgttcagaaatatccgcaaggcttacaggcccgccatctgcatttaaagcaatatctaaaacggctgtaactgcataacgacctttcgatgtaagtttcataaagaatccctaaaaattaattgcgcaatacttacatatctgactaatttagtcaattattctcttttgttaaatcaattcgtttttcaaccgcacttagcataccatttaaaatatttaattcgtttttctctaattttgcacgatagtataaacgctttaatttacgcataactccttgattttgaataaatccaagagactgatatatacgttctgtgtagtcaaaaaaataagctaactgatctgttgttggatagtttttctctattaaagaaagtgaatttttcttattattttgaactaagaaagccatacgcaattcataacttaccagttgcacagccattgctaaatttaaagaagaataatcaggattcgctggaatattcaagtgataatgacatttcagcagttcttcattggttaatccaatacgctcacgaccaaacacaatagctatcttgcctttatacgctacaactttctccgcgcattctcgaggctcgatcaatgtattttgtaaatgacgtaagcgagcacttgttccaattaccaaagagcaatcatcgacggcttcatcaaaactatcgacaaccctagcattttttacaatattttctgcgccagctgaaagggcataagattgttcatcaacagatttaggtgaaacaagacaaagctgggtcaatcccatcgttttcattgctctagccgcagaaccaatattaccactgtgcgaagtttcaattaaaacaatacgaatattttccaacataatgatgcccgactaaaatttaagggtattctaccacaataaccgctaaaaatagtcaagaatttaagcaaattaaagaaacttaaaatattagagatgaataataaaaatggtgggttgtgagagactcgaactctcgactgacggattaagagtccgctactctaccaactgagctaacaacccaactggacaactaaatcagagagtggtgggtcgtgaaggattcgaaccttcgaccaacggattaaaagtccgctgctctaccgactgagctaacgacccactgtactaatggatttatgataacgcatttgctctagaatcgaaagaataaattcattcgttcaagctaattggttaaattacaaacgatgaaaacaaaacagaatccaataaaaaatggatcctgtttttcaagtattagaaatactaagaattagtacgctaacactgcacgacggtttttagaatatgcagcttcatcatgacctaatactgcaggtttttcttcaccgtaagatactgtgcctaatttaccagcatcaacacctttaccagctaaataacctttaactgcatctgcacgacgttggcctaatgcgatgttgtattctggtgtaccacgttcatcagtgttaccttctactaatactttagcagctggcgttgcatttaaatatgcagcgtgcgcatctaagatttgaacgtattcaccagtaatgtcatatttatcaaaaccgaaataaacggtattgtaacgttgttgaagatcagcaacagagtaaccgccaaaagtttgagcagcaccattgcctgcagcatcgttgttagatgaactacaagctgctaatgcagctacagaacctgcaactaataatgatttaacaaatttgttcattagatttctcctaaatgagttttttatttagttaagtatggagaccaagctggaaatttaacttgaccatcacttcctggaaggctcgccttaaagcgaccatctgcagaaaccaattgtagcacctttcctaagccctgtgtagaactataaataatcataattccatttggagagaggcttggactttcgcctagaaaagatgtactaagtacctctgaaacgcccgttgtgagatcttgtttaactacattattgttaccattaatcatcacaagtgtttttccatctgcactaatttgcgcgctgccgcgaccacccactgctgttgcactacctccgcttgcatccattcgataaacttgtggcgaaccacttctatcggatgtaaataaaattgaatttccgtctggcgaccacgctggttcagtattattacccgcaccactcgtcaattgagtaggtgtaccgccatttgctcccataacgtaaatattcagaacaccatcacgagaagaagcaaaagctaaacgagaaccatctggcgaaaaggctggtgcgccattatgcccttgaaaagatgccactactttacgtgcgccagaatttaaatcctgtacaacaagttgtgattttttattttcaaacgatacataagccaaacgctggccgtctggagaccaagctggagacataattggttgggcactacgattgacgataaattgattatagccatcataatctgctacacgaacttcataaggttgcgaaccgccatttttttgcacaacataagcgatacgagttctaaaggcaccacggatcgcagttaatttttcaaaaacttcatcactcacagtatgcgctccatagcgtaaccatttatttgtcactgtatagctattttgcattaatacagcccctggcgtacctgatgcaccaaccgtatcaattaattgataagtaatactataaccattacccgatggaaccacttgtccaattacaattgcgtcaattccaatattcgaccaagcctcaggatttacctctgctgctgaagttgggcgttgaggcatttgagacaccgcaataggattaaacttaccactgttacgtaaatcatctgcaactattttgctaatatcttctggtgcagaaccaacaaatggcacgacagcaatagggcgcgcaccatcaaccccttcatcaatgacaatgcgtacttcatcgccagcgaatgcattgcttccaacagcaagtacaatcgcaaatacgctcactaaacgttttaataatttcattttgttacctttaaaatttaacaataaatttttctaaagaattatcgaatatcaaagtcaataattggtgatttatatttttcataaatttcatctgatggcgcagctggaacttttttcgttctagccaccgcacttaatgcagctgaacaaatatcatcagagcctgaaattttttgataccccaagattgtgccatctcgacctaattgaattttaatacgacaaacctttcctgcaaaatttggatcttttaagaaacgacgttgaatctctttcttaattacacctgcgtattgatccccaaccttaccaccatcgccagagccaagtgcagcaccgctaccttgagttccacctttatttgtgtttccccctttagatgcactaccgccaccaacatctccgccgttaaagaaatcatctaggcttgcttgatctgctttacgttttgcttccgcagcagcttttgcctcagcagcggctttcgctttagcttctgcatcagcttttgcttttgcctcagctgctgctttcgcttttgcctccgcttcagcctttgcttttgcctcagctgctgctttcgcttttgcctccgcttcagcctttgctttagcttcagcagcggcttttgccttagcttccgcttctagtttcgccttagtttctgcctcttgttttgctttttgagcagcaatttctgctgctttcgctttagcctcttcttcagcttgttttgccgcagcagctaaacgtttagcctctgcatctgcttttaattttgcagcttcagccgcttgtttagccctagcctcttcagcttgcttctgtttttccaacgcttcttgacgagcttgctcttgttgtttttttatttcttgctgacgttgctgttcttgctgacgttttaactcttcttgtcgttgaacttcttgttgatgcttaatctcttcttgtcgttgaacttcttgttgatgcttaatctcttcttgattaggctcaggtggtttttcttccacaacaggttctgggcgtttttgtttatccgcttgcccttttttttgttgttgaatacgcccccattcctgagcagccgtaccagtatcaacaatcactgcccctattacatctccttcaccttctccaccacccataatttcaacggtgtgataaagcgaacttaaaatcaataagccaaacaagataaagtgcaaaaggatagaaatagcaaaagcattgattcctttcttttgtcgattattttgcacgtgttacctacttagctaaatgggatttgtcattaaacctacagatttaatgcctgcaagatgaagtaaattcaatgccttaatcacttcttcataaggcacttctttagctccgcctactaaaaatagtgtattattatccttatcaaattcctgtctagataattgagtaaccatttcttctgttaaaccttcttgacgttctccgccaatagaaatcgcatattttccaatgcctgccacttcaagaatgacgggcactttatcttcattagaaacctcttggctttgcacagaatcaggcaattcaacttgaacgctttgactaataataggggcggttgccataaaaattaacactaaaactaaaagcacatctaaaaaaggcacaatattaatttcagatttaattgctttacgctgacgacgagccatatattcctctaaaattttaacttatttttaccgcactttttcttcaaagtgcggtcaattttccctatttttagtgaggggctttaccaaaggcttgacggtgtaaaatcgtcgtaaattcatcaataaaattaccgtaatcttgttcaatggcattcactcgtaagcttaaacggttataagccattactgcaggaattgcggcaaataaaccaatcgcagtggcaatcaacgcttcggcgatacctggtgctaccatctgtaacgttgcttgttttgcaccacttaatgccataaaagcgtgcataattccccaaacagtgccgaataaaccaatataagggctaacagatgccactgtggctaaaaatggaactcggttttccaaactttcaatctcacggttcatcgcaagattcatcgcacgcattgtgcctttaataatcgcttcaggtgcgtctggatttacttgttttaaacgtgaaaattctttaaatcccacgcaaaaaatttgttcgctgcccgttaatccatcgcgacgattagatagcccttcataaagtttatttaaatcttctcctgaccagaaacgatcttcaaacgtacgcgcttcttttaaggcattcgttaaaatacggctacgttgaataataattgcccaagatatgattgagaaagaaatcaaaatcacaattaccagttgcacaacaatacttgcttttagaaaaagatctaaaaaattcaattctgcagtcattgcatactccgaaaaattattttaagtgatgaaacgccgctttaacttctttgggaaacgccacaggtttcatcttgcctagatcaacacaggctaccttaacagtagcctttgataacatcagggtgttgcgcatcagtctctgttcaaaaaggattgtagccccttttacttctgaaacctctgtttccaccataagtaaatcatccaattttgctgccacgcaataatcaatggcgagcgttttgacaacaaatgcgagttgttgttcctctagtaaggtttgttgcgtaaaatttaatgtacgcaaatattctgttcttgctcgttcaaaaaaatgcaaatagcgagcgtgatacactacgccacctgcatcagtatcttcataatacacacgaacaggaaaagaaaagcaattatccaacatattctcacccaattggtcgcaataaaccctgtattctagaaccagtttttgggataagcaagctatctatgaaaaactcaataagattttattcattttaaaacatctaaaatttttaccgcacttttagtctgactagcaaaagataaggtaatgacaaatcatttttaacctttctcattgagcaaaatctattcaaaacataaccgttctttaaaaatagcctctatgtaatcttaagccaccagtatttttattcttgatatttagtgtttctatgcgacaatctttgcggttatttactttaaaaatatgttttactaaatggattacgaaaatcaaattgccaatattttctcactaaatggcgaattaagccaaaatatcaaaggttttcgtcctcgagctgaacaacttgaaatggcacatgctgtaggtaaagcaattcaaaataaatcttctcttgttattgaagctggaacgggtacaggaaaaacctttgcatatctcgcgccagctttagtttttggtaaaaaaaccattatttctacaggatctaaaaatcttcaagatcagctttttaatcgagatcttcctgctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagctgaaagttgtttaggcaccgattgccctaattattcagaatgttatgtagcaagtgcgcgtaaaaaagcattaaatgctgatttggttgtagttaatcatcatttattttttgctgatatggctgtgaaagaaagtggttttggcgaacttattccaaatgcagaagtgattatttttgacgaagctcatcagctgccagatattgccagtcagtattttggtcaatctttaacatcacgccagctttttgatttatgcaaggatattaatattgtctatcgcacagaacttaaagatatgcagcagcttggcacaacatctgataccttactgaaagtggtacaagattttcgtttattactgggtaatgggagtaatgttcgaggaaattggcgtgagctttacaagcaaagtgcggtgaaaaaatcctttgaattattacaagagaaaatagattttttagctgaggtaattaaattagcacttggtcgttcccaaactttagacagtatttttgagcgtgttgagtccattaaaatccaactcaaacgtttatctgaaacaaatattgtgggttattgttattggtatgaaggaaatggtcgccagtttggtttacatattacgccattgacggtagccgataaatttggtgctcagctcgaagcgaaagaagccgcttggatattcacatctgcgacattagaagtggggggaacttttaatcatttctgccaacgtttaggcattgaaaatgcgacacaaaaaattttatatagtccctttaattattctgagcagtctttgctttgtgtgcctcgatatttgccgaatactaatcaagtgaatacattaaattcactaggcgaaatgttattacccgtgattgaagcaaacaaagggcgttgctttgttctttgcacttcttattcaatgatgcgtggtttagctgaatatttccgtgaaaaaagtcatctttcgattttattacaaggcgaaacctcaaaaggcaaattactcgaacaatttataaaagaaacgcatagcgttttggtggcaacttctagcttttgggaaggtgtagatgtacgcggagatgcactttctttagtgattattgataaacttccctttaccgcaccagatgaacctttgttgaaagctcgcattgaggattgtcgtttacaaggtggcgatccattcaatgatattcaaattcctgaagcggtaattaccttgaaacaaggcgttggacgtttaattcgtgatgttacagatcgtggcgttgtgattatttgtgataatcgattagtgatgcgcaattatggcgaaacttttttgaaaagtttacctaactcaagtcgtacccgtgatctcaacaaagtgatacaattcttacaaaataagtaaacgagaataagaatgcaaaatttaactttattggcgttggacacctctactgaagcctgttctgtcgctttattgtatcgtggtgagaaaacacatattaatgaacttgcccaacgtacacacactaaacgaattttacctatgatcgatgaaattttggtaaattcgggtttaggtttaaatcaagttaatgctttagcttttgggcgtgggcctggtagttttactggtgttcgtgttggtgctgggattgcacaaggtttagcgtttggtgcggatttgcctgtcattccaatttcaaatttaaccgcaatggctcaggcagcatttgaattacatcaagcagaaaatgttgttgccgcaattgatgcgagaatgaatgaagtctatttttctcaagtagtgagagaaaaagtgcggtcagattttggagaagtttttcaatggcgagaaatcattagagaacaagtttgttctccagaacaagcgattaaccagcttcaaaatgataacgcatttagagtcgggacaggttgggctgcttattctcaatttactaaaaaaaatctaactggctcagatatagcattacctaatgccttatatatgttagaacttgcgcgagtagaatttttgcaaaaacacacaattccagctttagaaattgaaccgatttatttgcgaaacgaggttacttggaaaaaattaccagggcgtgaataagtttaaataactggaggatagaaaatgaaaggaaaaatcaccttattttttaccgcactttgcttgggattaacgggctgtattgcaccaccaaaagggttagaaaaagagcgattctcaattaattcctatcgcgagatttctcctcaggatttgacctgtcattgtaaaacagttcgacttggaggaaaaattatcaatactaccgttttagcaaatcaaacaaaaattgaagtgttaagtttacccgtatcatcaatttcaggtaaaccatttgttgaattgcaatccgatggtcgctttatcgtgtatttcaacggttttgttgagcctgaaaatttaaaagaacgttatattactgtaggtggtcaattagctggaacagagaaaggcaaaatagaacaagctgattatacttatcctgttgttcaagcggataaataccgtatttggacactcagtaccatctatgagtatccaacagatgattgggatgaagatgatgattggggattttttagatggagatatcgcccttggtatgttcagcctgaaattcgctattatttgaattaatgataaaatcttaaagattttccaacaaattaggataaaaaatggaaaaaatttggtttcaaaattatccagaaggttctgaaaaatttctagatacctcaaaatatgaatctattttggatatgttcgacaaagcagtgcgcgaacatccagatcgccccgcttacattaatatggggcaagtacttactttccgtaaattagaagagcgcagtcgtgcatttgccgcatatttgcaaaatgaatttaaacttcaacgtggagatcgcgtggcattgatgatgccaaatttattgcaatatcctatcgcactttttggtattttacgggctggcttaattgcagtaaatgtcaatcctctttatactccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaatttcgtcgtaaaatatgtgaaaaaactcgtgccgaaatataaattaccgcacgcagtaacattccgtgaagtattgagtattggtaaatatcgccaatatgttcgtccagaaatatcgcgtgaggatttagcctttttacaatatactggcggtacaactggcgtggcgaaaggtgcaatgctgacacacggaaatattataaccaatgtcttccaagctaaatggattgcagagccatttattggcgatcattctcgcactcgttcagctattttagccttgcctctttatcacgtatttgccttaacggtaaactgcttattatttttagagttaggtatcacggcgattttaattactaatccgagagatattgaaggatttgtgaaagagttgaaaaaataccgttttgaagcaatcactggtgtaaataccttatttaatgccttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggagtgttcgccattaatcgccgcttgtccaattaatgttgtgaaacataatggcactattggtgtgccagtgccaaatacggatataaaaatcattaaagatgatggctctgatgcaaaaattggcgaagctggcgaattatgggtgaaaggcgatcaagtaatgcgaggttattggcaacgacctgaagcaacgagtgaagtgttaaaagacggttggatggcaactggcgatattgtcattatggatgaatcatatagcttacgcattgtggatcgtaaaaaagatataattttggtttctggctttaatgtctatccaaatgaaattgaagatgtcgttatgctgaattacaaagtgtctgaggctgtggcaattggtattcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactgccaaaaaccaatgttggcaagattttacgtcgggttttacgcgatgaagagatcgcaaaacgtccaaaacattaatgtcaaaatgggatagcaatatcccatttttgttctttttaaataaaaaatcactatgataaaagaatgtcaaaatccaccgcactttagagtcatttcagataatgctgcactattggaaatttgtaatttggctcagatgaaaagtgcggttgccctagatacagaatttatgcgtgtttccacttattttcctaagttgggattaatccagctttatgatgacgagcgcgtctctttaattgatcctttagcgattacggatttttctccttttgtcgcattgttatccaaccctaaggtattaaaaatcttacattcttgtagtgaagatttattggttttcttacaagaatttgatcagcttccacgcccaatgattgatacacaaattatggcgcgctttcttgggcttggcacatcagcaggattggcaaaattagcacaacaatatttaaatatagaaatcgataaaggcgcaactcgcaccaattggatcaaacgccccctttctgatattcaacttcaatatgccgcaggcgatgtttggtatttgttaccgctttatcatattcttgaaaaagagttagcgaaaacaccttgggaacaagcagtaagagatgattgcgaactggctcttgctaaaacacataaattacaagagcgagattcagaaaaagcttatttagatattccaaatgcttggaaattaaatccatttgaattgtctcgtttaagaattttggctcagtggcgacaaaacgtcgcaatagagcgtgatttagcactttcttatattgtgaaatccgataatctttggaaagtggcaaaaaataatccacgtaatacatctgaaatgttagaaatgggattaactgaaaatgaagtacgcgtgcgtggtaaaaagattttacaattgcttgctcaagcaagacgcgtttcgcctaatgattacccaaaacctattgaacgtatttctgaagatcctcgttataaaaaaacaattcgattgttacaagaaaaagtgaatagcttaacaccagcaggtttaacccctgaaatccttgcgagtaaacgcactttggatgaattaattaaatgggtttggaaatatgattgttctcaagacaaactccccgagctgctgattggatggcgtaaacctattgctgaaaagttagtggatatacttaaataaatataaaaaagcgttgagcaaatagctcaacgcttttagtttttactcgtagagttttttcacttgttcaggtgtcatcactcgttgatatttactaaattcttttgccatatagtaagcaccaaaatttgttaagtgatcttgatccccatacaagtattttccttctgccataacactatcttttggtaaatactgttgagcatctacccaataaacattaggaatatctttgactaaatcatgaataattttgttactcgcatcaatatcgcccatacgatgaattggcgttaaatatttttcaagtccataattttctaataagtaaccacgcagtggagaacggcttactgagctattattagcaaaaacatatacgggcttttgcatcgctagttgtttcactgtgtttttaaaacgtgctttaaaatctggctctatgaaagtttcgggtctaaagcgaggtactggctgtccgcccattctcaagtcataaaatgctgaaataaatatcgctttatattgagaatctttctgccatacagattggcaattaggatctaattgatattgttcattcacaataaagctacattcaaatttatctttgaaaatatctgctttccagccttctttatttcccacatagtttagaaaagcttctaaatgtgaagaatgagaatcgcctaaaataatgaccttagcaggataatgattttcattagaaacaggaattgattgttcaatgtgttctttttcagctcgtattgtttgtcttttataaagattaaatcctaagagtaaaagagaaggaataaaataaatataaagaaaactttgtttaaagtttagtttcgattttctaattggttgttcgattaaataataacttagaactgaaaaaattattgttaatattattactatagcgatagattgattattaatttgtttttcgcccgttatataataagcaaacgcaataaaaatccaatggtataaataaagggaataagagatttttccaataaatactatcactttattggataaacataatttaataatgttattttgtgatgtggtatgaataattaatgctgtaaaaatacaagggagaattaaagtaatacctggaatatatgcaatatcattattcattaaaaataagcaggaaaataatagtaatgtacttaatattgcaataacattgcttgcttgcttgcttgcttgcttgcttgctgaaagattatgataaattgccaacaaagatcctacaagtaattcaggaaatcttaggttggagagataataaatattaggctgatgcaatacttctttgtaaaaattagctggaataaaagaggtggcaagtaaaataaaaaataaaattagcgttataataaataatactttaatttctctaaactttttataagctaaaatgaggattagtggaaaaataagatagtattgttcttctacggctaatgaccaaatatgtaatacagggttttcatttgcacttaaatcaaaataaccttgtgttaatcctagatagaaattagataggaatgcaatagctaattcaatggtttttcttaatttattgaaatcattataaataaaaataacagacgcaatgaaagacactaatgccatcactgtaataaaagcaggataaattcgtttaatacgtcgagtataaaattgtttaagcgaaaaagaattctgttgaatttctgtgataataatacccgtaatcagaaaaccagaaataacaaagaaaatatccaccccaagaaaaccgcctgataaccagttttcattaagatgataaataatgactgaaataacagcaattgcgcgtagtccatcaatttctggacgatatttaatagatgacataatattcctttaataaaaatataaaccgcactttgttctatgagtcaaaagtgcggtaattttttgtgtgtttttatacgttgaatcggaaatgcattacatcgccatcttgcacgatgtaatctttgccttctaaacgccatttacctgcttcttttgcaccgttttcaccgttgaattggataaagtcttcataagcgataacttctgctcggataaagcctttttcaaagtcagtgtggattacagctgctgcttttggtgcggttgcaccgactgaaactgtccaagctcgtacttcttttacgccagcagtgaaataagtttgaagatttaaaagtgcataaccagcacgaattactcggttcaatcctggttcttcaatgcctaaatcttgtaaaaactcgactttttcttcatcgtcaagttctgcaatttcagattcaatcgcagcacatactggaacgaccactgccccttctttttcagcaatttcacgaacgcaatctaagtatggattattttcaaaaccatcttcatttacgtttgcgatatacattgttggttttaacgttaagaagttgtaactcttgattgcttgcaattcttctttatctaacccaacagaacgaatcattccagcattttcaagcacaggaaggattttttccataacggaaagttcaaatttagcttctttatcgccaccttttgcacgtttttgtaaacgttggattgctcgttcacagctgtctaagtctgctaaagctaattcagtgttgatagtttcaatatcatcaagcggatcaattttccctgcaacgtgtacaatgtcatcgttttcaaaacaacgcactacgtgacctatcgcatcggtttcacgaatattagcgaggaatttattacccaagccctcgcctttacttgctcccgcaactaagcctgcgatgtccacgaattccatcgtagtaggtaatatgcgttcaggcttaacgatttctgccaatgcgtctaaacgtggatctggcattggcacgacacccgtatttggttcgatagtacagaatggatagtttgcggcttcaatgccagctttagtgagtgcgttaaaaagagtagatttgcccacatttggcaatcccacaataccacatttgaatcccataatttttccttattttgagtaaaacggttgtaaaactaaccgcacttttaaattttaaaactgtttaaacgattggtcgctttgatcattccatctttgaaaattatttctacacaatcagttgcctcatctaacactttttcaagtgcatcgcgatctgctggagatggtttatttaaaacataacctgccactaaatcacgatgaccaggatgcccaatgccaatacgtaaacggtagaaattattgttattgcctaattgagccacaatatcttttaagccgttatgcccaccatgtccaccgccttgtttgagtttcgctgtgccagcaggcaaatctagttcatcgtgaataaccaaaatttcttcaggtttaatacggtaaaaacttgccaacgcgccaactgctttaccgcttaaattcataaaagttgttggcactaaaaggcgtacttcttttccattcactaaagtgcgggcagtttttccgaagaatttactttctggatttagtgaaacgttaaaacgacgagccaagcgttcaataagccattcgcctgcattatggcgtgtatcggcatatttttcgccaggattgcctaaaccaacaatgagttttatttctgacatttttatttgatgatgtaaaaatttgatgatgtaaaaaatagtggcgtattgtagcgaaaaagccttaaattctcaatctataaggcggaaacaaagaggtaatttattgctcgtgatttatcattaaaagtcaccgcacttttccgttataatggctaaaattttttaacaaagaagtaaaaatgaatcagattaacattgaaatcgcttatgcttttcccgaacgttattatttgaaatcttttcaagttgatgaaggaatcaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgctgatccgaaagaaattcgccgtaaacgtgcagcagagcaagctgcagccaaagacaaagaaaaaggagcttaaaaatgaccgcactttcatccgttgatttttgtttacctgaacatatcacgccagaaatttttctacgtgattattggcagaaaaagccacttgtgattcgtaacggtttgcctgaaattgttgggcagtttgagccacaagatattattgaacttgcacaaaatgaagatgtcaccgctcgtttagtgaagacattttctgatgatgattggaaagttttttttagccctttgagcgaaaaggatttccaaaaattgccagaaaaatggtcggtgttggttcaaaacttggagcaatggtcgcctgaattaggacaactttggaacaaatttggctttattcctcaatggcaacgtgatgatattatggtgtcttacgcaccgaaaggtggctctgtcggcaagcattatgatgagtatgatgtatttttagtgcaaggctatggccatcgtcgttggcaagtgggtaaatggtgtgatgcaagcactgaatttaaacccaatcaatcgatccgaatttttgatgatatgggcgaattagtcattgatgaagtaatgaatccaggggatattctctatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttgtttaagcaagccgtagcaagtgcggtaagttctcgtcgttatgagttattagtctctgatgaaatgtgtgatcctgatgaagtgcggtcaattttagaagaagatggcgcattcctttctcaagacaacaattgtaaattgctttacaccgaaaatccgttgcgaatttatgcgaacggcgaatggttagatgaacttaatataattgagagcgaagtattaaaacgcttgtctgacggcgaaagtttagattgggcgtttttatctgatttagccaataaaacagaagatcccgaaacctcaatggatttgctgttagattcaatttgtaactgggttgatgatggttgggcgttaattgaataatatgtcagacaatatttattccgtctctcaactaaattctgccgcacgtcagatgttggagggtaatttttcccaaatttggctaacgggggaaatttccaattttacccaacctgtgtctgggcattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcaacttattattgattctatgcacccagcaggcgagggattattgcaacagcaatttgaagcgttaaaaatgaagttggctgcggaaggattgtttgctcaaaatcttaagaaaactctaccgcactttagtaaagcagtggggattataacttcttctacaggtgcggcattgcaagatattttgcatattctggcacgccgtgatccaagtttaaaagtcgtcatttatcccactgcggttcaaggcaaagaggcaactgcagaaattgtgcaaatgattgaacttgctaatgcgcgacaagaagtagatgtattaattgtggggcgtggtggtggttcattagaagatctttggtgttttaatgaagaagaagtggcgcgagcgatttttcgttcaaccttacctattatcagtgcggtgggacacgaaacagatgtgacgattgccgattttgttgcagatcttcgtgcgccgaccccttctgctgcggctgaattagttagtcgtaatcaagatgaattattgcagcaacttcgccatcaacagcaacgtttagatatggcatttgatcgtttatttacgcgaaaaagccagcgtttgaaacagcttgccttacgattgcaaaatcaacatccacagaatcagctacgtgctcaacaagcgaagaatgggcagctttcacgatcgcttgcaacttgcaatattgcgtcagtttgaaaatacacaacaaagattcaccgcactttctgttcgtttaaaacaaaatccattgccatatcgcatacaacgttatcaacaaggcttagagcagttaaaagtgcggttaaatttttgcgtaaatcgccaagtgacggaacgtcaaaataaactggcaacattatgcggaaaactggatggcttaagcccattaaaagtcttggcgagaggttattccattgcggaaaatccgcaaggtaaagccattgttagcgtgaaagatgtcaatcaaggggacttcattacaactcaagtggctgatggaaaaattgtgagtaaggttttgtaagatgcttattttgtaaaaatggagtgaaatactgtttcacttacttctaaaaaagaatgctatgactgttgaataaataatcatggcattttgtttttttgtgactcacttcaaactctcaacaaaaagtggaaaccttctattttttttgtagtcttttaagcgtatgattttgcgtgcagttttggagaaaacagatgtcagaaattcaacattttagccaacaagatatagaaatattgggcgaacaaactttgtatgaaggttttttcacgcttaaacgaatccaatttaaacataaactttttgctggggggcaaagtggcgtcgtaacccgagaattactgattaaaggcgcagcctcagcggttatcgcttatgatccaaaagaagattcggtgattttagtcgaacaagttcgtattggtgcggcttatcatccagaatctaatcgttcgccttggttactcgaactaattgcaggtatggtggaaaaaggcgaaaagccagaagaagttgctttgcgtgagagtgaagaagaagcagggattcaagtcaaaaatttaacacattgcttaagtgtgtgggatagcccaggtggcatcgtggagcggattcatttatttgcaggcgaagtggatagcacacaagcgaaaggcattcacggtttggctgaagaaaatgaagacattaaagtgcacgtagtaaaacgtgaacaggcgtatcaatggatgtgcgaggggaaaattgataatggcattgcagtgattggattgcagtggcttcaattaaattatgctcagttacaacaaagttggaaacgtagttagggggcattaatgaaaaatacgtttgtttatcaggcggaaaagcctgttataaagttattacaaattaccgatccccatttatttaaagatgaaagtgcggaattattgggggtaaatacacaagcaagttttgctcaagtattaaggaaattcagcaagaaaataccaatttgatgtgattcttgccacaggcgaccttgtgcaggatagtagcgatgaaggttacattcgttttgtagaaatgatgaaacctttcaataaacctgtgttttggattccaggaaatcacgactttcagcctaaaatggcagaatttttaaatcagccaccaatgaacgcagcaaaacatcttctattgggcgagcattggcaagccttattgttggatagccaagtttatggtgtaccacacggacaactaagccagcatcaactcgatttattaaaagaaaccttagaaaaaaatccagaacgctataccttggttgtattacaccatcatttattaccaactaattccgcatggcttgatcaacataaccttcgtaattctcacgaattggcagaagtgcttgcgccttttagtaatgtgaaagctattttatatgggcatattcatcaagaagtaaatagtgaatggaatggttatcaagtgatggcaacgccagcgacttgtattcaatttaaacctgattgccagtatttttctcttgatacgttacagcctggttggcgtgaaattgagttatactcagatggttcaattcgtacggaagtaaagcgtattcagcaagcggaatttttaccgaatatgcaagaagaaggatattaaattttgtggacgttttaaaaatcactttcatagtaagcatttttaaaacgtccactattctaacccaacaaaagtgcggtcaaatttttaattgtttttaacgattcgccagttcaaaaatcatcgcttctgcttggcaactaaaagtgaaagaggcatttaatgaacaccgttttcaactgccacgatttcgcttttaatttcgcaaggatcgctttctatatcgcgcgctttcttcgttaatcgttcaagtgcggcattggcatctgcttctgtgctataaacttgatgtacttctacgctacagtcagagccatcaataatcgtgcctacatcaacacagctgcaagttaaggattcttctgctttgcattttacggtcattttcttttccttatatgaatattttttcgcattttatcatttttcttttttcccataaatgacaaaaattgaacaaaacaatccattaaatgcaaaaaactcctgctaactgatcgtagctctaataaaaatagttgcactcaatagattctggtttataattgcccaaatttttatttataacaaagggttccaaatgaaaaaatttaatcaatctctattagcaactgcaatgttgttggctgcaggtggtgcaaatgcggcagcgtttcaattggcggaagtttctacttctgggcttggtcgtgcctatgcgggtgaagcggcgattgcagataatgcttctgtggtggcaactaacccagctttgatgagtttatttaaaacggcacagttttccacaggtggcgtttatgttgattctagaattaatatgaatggtgatgtaaattcttatgctacaataacatcagcaagtagtggagtgagaacaataaagcacggctcagcttcacagcgtaatgttgttcccggtgcttttgtgccaaatctttatttcgttgcaccagtgaatgataaattcgcgctgggtgcaggaatgaatgtcaatttcggtctaaaaagtgaatatgacgatagttatgatgctggtgtgtttggtggaaaaactgacttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttctaatccgttaaaaaatttagcataataaagcacacttccacaccaagtgtgcttttcttttataaaacaaggcgaaaaatgaccgcactttattacacttattacccctcgccagtgggacggcttttgattttatctgacggcgaaagcattacacatattgattttgaaaaagagcaatatgcgcctaatccaaaatggctcaagcaagatgaattgcctgtttttcaaaaagtgcggttagcttttgaacgatattttaatggggaagttgagcgatttgcagacattcccttaaaaccagaaggcaccgcatttcaacaagccatttggcaagccttgcgagaaattgcttatggcgagctttcaacttatggcgagctggcgttacggattaataatcctaaagctgttcgtgccgtgggcggtgcggtaggcagtaatcccattagtattattattccttgtcatcgcattttaggtaaagatcgtactttaactggttttggcggtggcttagaggcaaaacgttttttattgcagttagagaaaattccctatattgataaaggcactgaaaacactaagcctcgcttttttaagaaatatcacgaatgattccacaaactcttgaacaattactttcccaagcgcaatcaattgctggcttaacttttggggagttagctgatgaactgcatattcctgttccgattgatttaaaacgtgataaaggctgggtgggcatgttattagagcgtgctttaggcgcaacggcagggagtaaagctgaacaggatttctctcatttaggtgttgaacttaaaacattgccgattaatgcggagggttaccctcttgaaaccacctttgtgagccttgccccgttggtacaaaattcagggattaaatgggaaaattcccacgttcgccataaactttcttgtgtactttggatacccattgaaggcagccgtcatattccattacgtgaacgccatatcggtgcgccaattttctggaagccaaccgctgagcaagaacgtcaattaaaacaagattgggaagaattgatggatttaattgtacttggcaaattggagcaaattaccgctcgaattggtgaagtgatgcaacttcgcccgaagggcgcaaatagtcgtgctgtgacaaaaggcattggcaaaaatggcgaaattatagataccttgcctttaggtttttatctaagaaaagaattcaccgctcaaattttgaaagcgtttttagatgtaaagccgctttaacttgattttaatattcgtcaaaaacacggaaaaaaccgaccgcactttttagctcattgccataaaaaattaaagggatccgatttcgttcccaaggtggtacgcttaattcttgccagattttttttatatcttctcttgggcgtttcggatgatgtttcactttgcccgaatagccaaaacgaatagaaataggcaagttcgttttttccagcgtaacagagtaatcctgccagtagaaaatcagattatgttcattttcgtgaacagtgagattgcctaaatcatcgggtaaatttagcatgttttgttctaattttagggtgcatttggttagatcagaaaacggcttagttaaatataaactatcttgataacgtcgaataactttatttacaagctgaaattgaggatttgcctcttcttttgcaaaaatgacatcattaataagctgtgtaagctggcgtttacttggcatttcaagttggtttttggcaagccacatacgcaaaagtgcggtctgttttgcgagagaatattggcgaaattggagcagtttaaattggtttttaatttgacaatgttctgtaaaaatttcgctcaataaatcattaattaactgttgttgctcaaaacaatgttgtgcggaacgttgtacggctaaatcaaaatgcgcccagcgttcacgtaattttggcaaaatttcattgcgtaagaaattacgatcgtatcgattatcctcattactttcatctgtaacccagttgagcttttcttgttgcgcataatcttctaactgtgggcgagtaaaacctaacaaagggcgaaaaattggcattccgaataatacactttgttgttgcattgcgcttaagccttgtagcccactgccacgttttagggctaagaaaaatgtttctgtttgatcgtttagatgatgcgctgtaactaacatttcttgtatttgaagatgtttttttatggcttgatagcgtgcttcacgcgcccctgcttcaatgccattggttttatctacttgtactcgctcgataatcaatggaatttgaaattgatcgcacaagttttggcagtgtttagcccaactatctgcattggggcttaagccgtgatgaatgtggattgctcgtaccgataaaggcggtaagtgcggttgtttttgacaaagttttgcaaataaagaaagaagtacagtggaatctaaaccaccactcaaggcgataagaaacccttgagcggtggctttttggagttgtttttcaatgtctgaaagtaaatccattaggcaactttttcagctttatagttactgcttggattaagaatttcaaaacgtgcagcaatggtttgtaactcgtaagaacccagttcaaaggtggttttcattgtgttttctcctttgttgtatatttagatcaaaaaagagcggcaaaaatcaccgctcttttagaaagttagttagcaataaccataagacattaaacgttcatagcgtctatttaataattcttctttgcttagttcatcgagttcagctaaatcttcttttaaacgaagttttaagttttcagctattttcgcataattgcgatgtgcgccacccaaaggttcttgcataatgctgtcgataagatttaattcttttaaacggcttgcagttaatcccattacttctgctgctgttgatgccttttccgcacttttccaaagaatagaagcgcagccttctggagaaataacagaataagttgaatactgtaacatattcactttatcgcccacgccaatagctaatgcaccgcccgaaccaccttcgccgataacggtacaaataacaggaacggtaagctgtgccatttcgcgtaagttacgggcgatagcttccgcttgaccacgttcttctgcgccaatacctggataagcccctggtgtgtcaataaatgtgataattggcaatttaaaacgttcagccatttccattaaacgtaacgctttacgatagccttcaggtgcgggcataccaaaattgcgttgtactttttcttttacagaacgacctttttgatgaccgataaccatcactggacgaccatctaaacgcgccaagccaccaacaatcgctttatcatcagcaaaagcgcgatcccctgcaagttcttcaaattccgtaaaaatatgttcgatataatctaatgtataaggacgatttggatgacgcgccatacgtgaaacttgccaagcatcgaggttagcaaaggtttttttagtgagttcgttacttttcttttgtaagcgtttgatttcatcagttaaatcaactttatcatctgatgctgctcgtaatgcttcaatttttgcttctaattcagcaatcggcaattcaaaatctaaatattcttggttcattttgttatcctaaaaagaccgtaaaaatcgaccgcactttatcaagaattaaactgtggcgcaaatggttttcactggttgggcaagcttataatcgctcttttttgaagagtgataagacaaataaaaacgcagaacaaatcacaacagaaggcccagcagcagtatcataaaaggctgataatattaatccacctataatcgataacatactcataataatcgcccagcccaccatagattctggcgttctcgcaaagcgacgagcggttgccgcaggaatgattaataaggatgtgataattaatgcaccgacaaatttcatactcaaggcaatcgtcaatgcggttaatatcattaaaataaaacgcatttttttgatattaatgccttcaacttgtgcgagttctggcgatacggtggtggaaagtaaggattgccaaaagtaaattaatgttgaaagcacaattattacgccaatcccgatataaattaaatccgtataattaattgcgagtaaatccccaaataaataattcattaaatctacccgtacattccgtaataatcctactgtcacaacgccaagagataaacagctatgggcgataatgccgagcaaggtatcaatagaaaattgcgtattgctttctaaccacaccattgcgatagcaagaattaaggtaagcaccacaatcgcaatgtaaggattgacttgtaagaaaatacctaatgctacaccgagcaaggcagaatgagaaagggtgtcgccaaaataagccattttacgccacaccacaaatacgccaagtggcgcggtaataagcgaaagcacaatgcctgttaaaagggcaggaaataaaatttcaaacattatttatccttattttgacaatgcactgctgatgaattacaaccgcacacatcgccgtgcaaggtgtgatgatgattgtgatgatgggtataaaagccgacattttgtgcgatctgatttccccataaacgcataaatgttggatcatttgagagaacatcgggcgtacctgcacaacaaatatgttggttaatacacaatacttctttactatccgccatcacaatatgtaaatcgtgtgataccatcaatacggcacaatttaatttttgttgggtttgatgaattagctgataaagctcagcttgaccagtaatgtctacgccttgagtgggttcgtctagcacaagtaaattcggtttatttaaaattgcacgcgtcaataatacacgttgcatttcgccaccagaaagtttttgcatattgcttttgcgtaaatgtgaaatcgaaagttgctcaagtgcggtggatatttcttgggttttaatgcctttttttagcgaaagaaatcgctcaaccgtaataggcaaactatgatccaaatggattttttgtggtacataaccaatgcgaacatttttactataaatgacttcgccagaagtgggcatttgtagttttaataaggtttttaacaacgtagatttgccaccaccatttggccccacaatggtaataatagaattgggatagatatttaaattaatatcttgcagagcggttttttgtgcgaaaaccacattgatattttttaattgaatgagcggttgtgggttttgctcgttgcgaatggctgtgatattcataaaatcgccgtgttttcaacaatggttggggaaaataacgcatttttatagaattctcaagattttctatccaatgtcgaatatttaagcatttgaataatgctttttccataggaatgaattttctttataatctgtagtctgaatgctgaaaacttttttattttagggatgccagtgcaacacgtaaaattagctcgagatagacgaaaaaaacgcacatatataaaagtaggcgtgttttttgttgctattctgcttattttgacaggcattttacttacaataaaagacaaatctgaagaaaatcccatattttccacctctgacagtggggaatatcacgagttaaatacatcgccaaataaaaattccaccgcacttcaacctgatgaagatgccacctcttatgatgatgaactgcaagcaaaagatgatgaagttgatgaagtaaaactatcttcagatgatctcggtactttacctcaacacgcacaagacgcactcaatggtttattagacgcggccgatcaagccataagaattactgatcaatttagctatacggtaaccgaaggggatacgttaaaagatgttttagttttatctggtttagatgattcatcagtacaaccgttgattaagcttgatcccgaattagcccacttaaaagcaggtcagcaattttactggattttaaataaaaatgataacttggaatatttaaattggctggtttctgaaaaagaagaacgtatttatgaacgtctcgaagatgggaaatttaaacgccaagttattgaaaagaaaagtatttggcgaaaagaagtattaaaaggcgagattcaaaattctttaaatagtagtttaagagaacaaggtcttgatacgcgacaaattagccaacttagtaacgccttacaatggcaagtgagtttacgaaaactaaaaaaaggcactcaatttgccattttagtttctcgtgaatatttaggcgataaacttacaggtcaaggtaatgttgaagcgttacgtatttcatctggtggtaaaaattattatgcagtgcaagcggcaaatggtcgttattataatcagcaaggggaaactttaggcaaaggttttgctcgttatccattgcagcgacaagcgcgagtttcctccccttttaatccaaatcgtcgccatccagtaacaggacgtgttcgtccccataaaggcgtggatttctctgtttctcaaggcacaccagttattgcaccagcagatggtacagttgaaaaggtcgcttatcaggctggcggtgctgggcgttatgttatgttgcgtcacgggcgtgaatatcaaactgtttatatgcacttgagcaaatccttagtaaaagcagggcaaaccgttaaaaaaggcgaacgtattgcgctttctggtaacacgggcatttctacggggccgcatttacattatgaatttcgtattaacggtcgagcagtgaatcctcttactgttaaattacccggtactagcagtggtatgacttcagctgaacggaaacaattccttgttcgtgttcgtgaagctgaaaaaatgttaaaaccttagcgatataaagtgcggtcaaaaatggtcgcatttttaccttatgtaaaataatatttacactttgttgtaaagaaattatcatagccatatcttaattatctccattccctgaatatgacgatttctaaatttaatccacaaaaacctttcgagtgttttattgtacaaagtgaagcgatgaaaagtgcggtagaaaacgcgaaacgttttgctatgtttgatgtgcctttgttaattcaaggcgaaacggggacaggaaaggatttgttagcgaaagcctgccattatcagagtttacgtcgtgataaaaaatttatcgcagtaaattgtgctgggttgcctgatgaagatgccgaaagtgaaatgtttggtcgaaaagttggcgacagcgaaaccattggtttttttgaatacgcaaatgagggtacagttttactcgatggtattgctgaactttcattgggtttgcaggctaaattattgcgttttttaacggatggatctttccgtcgagtaggcgaagaaaaggaacattatgcaaatgtacgtgtgatttgcacatcacaggttccactccatttgcttgttgagcaaggtaaagtacgtgctgatttatttcatcgcttaaatgttcttactcttaatgtgccgccattacgcgaacgcatgactgatattgagccactggcacaaggttttttacaggaaatcagcgaagaattaaaaattgcaaaaccaactttcgataaagattttcttctttatttgcagaaatatgactggaaagggaatgttcgtgagctttataacaccctttatcgtgcctgctctctggtacaagataatcatttgactatcgaaagtttaaatcttgctccgccacaaagtgcagtaatttctttggatgaatttggaaataaaaccttagatgaaatcatcggttcttatgaggcacaagttctaaaattattttatgcagaatatccaagcacgagaaaattggctcaacgtttaggcgtttcccatactgcgattgcgaataaattgaaacaatatggaattggaaaataattttccgatttgaaatggaaaaagtgcggttgaaatttcctaagaattttcaaccgcacttaataaatattgattgtccattaatggtgttgtgattactctgcttgagtttccacgttttcaactgcttctgttggagtggtatgatggttattattgtgatgcgaaactgaacgagcaggcacaaccgttgaaattgcgtgtttatataccatttggttcactgtgttttttaataaaatcacgaattgatcgaatgattcaatctgaccttgaagtttaattccgtttacaaggtaaattgatacaggaatgcgttcacgacgaagcgcatttaaataaggatcttgtaaagattgtccttttgccattttgctatcctttgttgtcgttattatgaaatttgttgatagaaacgagttgtctccgtgtgcaagtgtagcaataaacagaaatattgtctatttgctttcccgcaacttttgcaaaattgctttcatttgatgatctagtgacgcattgaaacgtagtgtttcgccatttttagggtgttcaaaccgaattgaaaaagcgtgcaaaaacaaacgatttaatcctaattcattcatttgtttatcaaaatctttatcgccgtatttatcatctaatgcaataggatgcccagcatattgtgtatgcacacggatttgatgggttcgccctgtgactggtgaagccttcacaagcgtagcatttatatagcgttcttcaatgctaaagcgagtttcagatggttttccttgctcgctgacacgcacaatacgctctccgctagataattcatttttcaaaagaggggcttgaataacttttatatgggattgccattgcccacgtactaacgctaaataatctttttgaacggttttgacgcgaagttgttcgtgcaaattgcgtaatgctgaacgttttttggcaattaataaaatgcctgatgtatcgcgatctaaacgatgaaccagttctaaaaagcgtgcttctgggcgtaatgctcgtaaggcttcaatcacaccaaaatttaaaccacttccgccgtgcaccgcgattcctgagggtttatttaaaataatcaagcaatcatcttcaaacaaaatttggttttcaagtgcggcaactttattgagattttttgaaatcggcgcatcatttttttctgcgacacgcacaggtggaatgcgtacaacatcgcctgtttgcagtttatattctggtttaattctgcctttgtttactcgcacttcgcctttacgcacaatgcgataaattaaacttttaggtacgcctttgagttttgctaataaataattatcaattcgttgtccactttcatcttcactaattgtcagcatttttacggatgaattaatgattttttcattttgttttgtcattttttttccttttgaaaatcggtgcaaatcatatcataaaggcactataaacgtaatatgaacatcactctatgaacgcaaattcgccttgctaattaatcgttttctatggataatagaacgtctttttgcgcctaagaatttgcgtaaaaaaggataagttttgttggtaaaaactcaatgcagcactcggcataagacattgataatcaacatttttcttaaaataaattagccgcttgcaacgcgtgcggaatatcgcgttgttttatcaagcgaatatttatgcttaataacgttatcaatgcacccagcaacatacagtcgtgagattgactggcgcgagaaacacgaggtcgataatgaagcaaagtgcggtttattttgaggttttttaaatatttaataagagaattgacaatgaaaagaatgttaatcaatgcgactcaaaaagaagagttgcgtgtcgcgcttgtcgatggacaacgcctttttgatttggacattgaaagtccaggacacgaacaaaaaaaagcgaatatctacaaaggaaaaattactcgcgttgagccaagcttagaagcggcttttgtggattatggtgcagaacgtcacggttttttacctttaaaagaaattgcccgtgaatattttcctgatgattatgtttttcaaggtcgtccgaatattcgcgatattttgaccgaaggacaggaagttatcgttcaagttaataaagaagaaagaggaaacaaaggtgcagccttaactacttttgtttctcttgctggcagttatttggtgcttatgccgaataatccacgggcaggaggaatttctcgccgtattgagggcgatgaacgtactgaactaaaagaagcattaagttcattagatgtgcctgaaggtgtaggcttaatcgtccgtactgctggtgtgggaaaatcgccagaagaattacaatgggatttaaaagtattattacatcattgggaagcgatcaaacaagcttcacaaagtcgtccagctccatttttaattcatcaagaaagcgatgtgattgtacgcgctattcgcgattatttgcgtcgtgatattggtgagatcctgattgatagcccaaaaatttttgagaaagcgaaagagcatatcaaacttgtgcgtcctgatttcatcaatcgcgtgaaactttatcaaggcgaagtgccacttttcagtcactatcaaattgaatctcaaattgaatccgcattccaacgtgaagtgcgtttaccttctggcggttcaatcgttattgatgtaactgaagcattaaccgccattgatattaactccgcacgttctactcgtggtggcgatattgaagaaaccgcattaaataccaaccttgaagcggcagatgaaatcgcgcgtcaattacgcttacgtgacttaggtggattagttgtcattgatttcattgatatgacaccaattcgccatcaacgtgaagtagaaaatcgtattcgtgatgcggttcgtccagatcgtgcccgtattcaaattagccgaatttctcgttttggtttgttagaaatgtcacgtcagcgtttaagcccatcattgggcgaatcttcgcaccatatttgccctcgttgtcaaggaacaggcaaagtgcgtgataatgaatctctttctttatctattttacgtttgctggaagaagaagcattaaaagagaacaccaagcaagtacataccattgtgccagtacaaattgcctcttatcttcttaacgaaaaacgcaaagcaatcagtaatattgaaaagcgtcataatgtcgatattattgttgccccaaatgaagcaatggaaacaccgcactttagtgttttccgtttacgtgatggcgaagaagtaaatgaattaagctataacttagcgaaaattcactgcgctcaagatgaaaatactgaagaatcactgctttctcgtaatgtggaaacaacagctgttattgaacaaccagcggttgaaagtgcagtagttgcactttctatttcagaagcagccccaacgccagttgagcgtaaatcaaatgaaccctctttgttagctaaaattattgcgaaaattaaaggtttatttgcgactaaatctgaagaaaacaaaccgaaaaataaccgcacttcgcgcaatcctaatcgtaatcaacgccgttcacaggatcgtcgttcttctcgtcgtccacgttctgaaaataacgaaacagaaagaaccgaagaacaggttcgtaatgtccgtgagcgtaatcaacgccgtccgcgccgtaacttagtggaagaaagtatcgctgaaagtgcggtaaattctacacctgtttttgaggctaaagaagaaagaactgagcctgtaactcaacgccgccaacgccgtgatttacgtaaacgcgtgcgcgttgaagataatgaaacagttgttgaaaataacttcagcacgactgaaaaaatgccagaagtggatgtaattacggttcaaaataatgatgaaaaacccgttcatcagaaccaacgttctgaacgtcaagagcgtcagcgtcgtactccacgtcatttacgtgcagcgaataatcagcgtcgtcgccgtaatcaagagccaaaatcgccaatgccattatttgctgcggtggtttcgcctgaattggcaagtggcaaggcttggattgattattcaacggtaaatctgccaaaagaaaatcatttcttatctgtggatgaattgcttgagcaagagaaaactaaaaaagggtttatcacgccagcaatgggaattgtcgttgaagaaaaatcccctgatgtaaaacctgcattagattttattactcaaccagctaatgaatcggtacagaaaaaagtacaagaatctttagaccgtttaagttcatataaacctcaagaagttgttgaatctattgatccagcaattaatgtagatgaacctgaaacgctcgagaaagtatcaaaatttgtccgcacttatgaatttaatggacgtttaggtacaatttcttcagtaccccatacaaaagcggagatgactttagcgaaagcaaatgatgaaatgccagaggctttcccaattagggcttggcaggattctcgttattatttctatggaaaaggtgcggcaggacatcattgtgcaattagccacgtttattctgaaccaacccgcgcaaaatcagaataatcaaaaataaaaatagaattgacgtaaccaaaattacgtcaattctttttattttataaatacagtttgattgaaagcataaaaaaccaatcagtcaaattttgctgttattttatgctttaattaaaacatttttacttatattataaaacagagtaagttgggcatgttgctaccagcggttacacaaaagatgaatttacaacaaaacttacatttaagactaacaatatgccaataggcggagatgtgaaggcggatcaggaaacatcaggttctagaagcataaaacgcattggctttggttttattggtggtattggctatgacattacaccgaatattaccttagacttagattatcgttataacgattggggacgcttagaaaacgtgcgttttaaaactcacgaagcctctttcggtgtacgttaccgtttttaattaaacaaatttagttttctatttaagcggtcaaattcttctcattatttgcaaaatgagggaaaaatttgaccgcttgttttttcttgaaaagaagcgtaaacttcatgcaatttttagtcggggtgccgaaaggctgagatgatacccgtgaacctgaaacagttagcactgacgtaggaaactaatatgccacatattcaacctttctctatcacgattttatcctgtttatttttccaattttctacattttattacatccgctaattgctcacagtgaatagcgggcatttttgtttattttatattcaatacaaggaatgcttatgcaatcaatttatctctccaaaatccgtgagcagaatccgctcattcataacatcaccaacattgtggcagcaaattttagtgccaatggcttgttggcattaggagcttcgcctttgatgtcggcgaatatcgaagaaatgcaggaagtaccgaaaatcagtcaagtattggtcattaatattggtacgctgattggtaaagatcgggaggcaatgttgcaggcaggaaaaacggcaaatgaggttggaattcctgtagtgttagatcctgttggtgtgggggcaacgagctatcgccgtgagaccattcgccaattgctggcagaagtaaaattcgcacttattcgtggtaatgcaggtgaactggctgccattgcaggcgagacgtggcaggcaaaaggtgtagatgcagggcaaggcgaagtggatttaaaagccgttgccgagaaagtggctcaacgctatggctgtacggtgttgattagcggggcggtggatattgtcagcgatggcacacaaactgcgaccgttcacaacggcacgtcattgttcccgaaagttacggcttcgggctgtttattgagtgccgtgtgtgcggcttttttagcggtaagtgaaggaaattatttttctgcgacattagaagcctgtgtagcatacaccattgcaggcgagtgtgcggcgcaaggcttaaccacacaagtgggacagttccaaatccgtttgttggacgagcttgctgccctttcccctgaaaccattggacaaagagggcgcatcaatgagtaatgtgaaacaagttttaaccatcgcagggtcagacagtggcggtggtgcaggcattcaagcggatcttaaaaccttccaaatgcgcggcgtgtttggtacatccgtaattacagctgttactgcacaaaacacacttggcgtatttgatattcaccctattccactgaaaacaattcaagcgcaactggaagcggtcaaaaatgatttccagattgcaagttgcaaaattggtatgttgggcaatgcagaaattattgaatgcgtggcagattttcttgctgataaacctttcggcacgctggtgctagatcctgtaatgattgccaaaggtggtgcacccttattgcaacagcaagcggtaagtgcattaagccaaaaattgctgccgttggcggacgtgattacaccgaacattcccgaagcggaagcattaacggggattgcgattgtggacgacatcagtattcaacaagccgcaaaagcgttgcaaaaacaaggagcgaagaatgttattattaagggcggacattcgctcaattcgcaaagtgagctgtgccaagattgggttttacttgcagatggtcgtcattttactttgcaaagcccccgtttcaacacgccgcatacacacggtacgggctgtaccttttctgcctgtttaaccgcagagttggcgaaaggcgaaccgttgcaaagtgcggtaaaaacagcgaaagattttattaccgctgcgatttctcacccattgaatattgggcaaggacacgggccgacaaatcattgggcttacagtcgcctttaaggattgaaagatgaaaaatattcaaaaaatcttaccgctttactttgtggcaggcacgcaagattgccgtcatttgggcgagaacttgtcggaaaatttattattcgtgctaaaacaagcgttagaaggcggaattacctgctttcaatttcgggataaaggcaaattttcgttagaacatacgccctcagcacagaaggcactggcgatgagttgtcgtgatttgtgccgtgaatatggcgtaccgtttattgtagacgacaacgttgatttggcgttggaaattgaggcagatggcattcacgttgggcaaagcgatatgcctgtgcaagagattcgagctaaaacagataaaccgctaattattggttggtcggtgaatcgtttagacgaggcaaaaattggggaaaatttagcggaaattgattattttggaattggcccgatttttccaacgcaatcgaaagagaatccgaaaccaacactaggaatggcgtttattcaaactttgcgaaatgtgggcataactaaaccgcttgtggcaattggtggggtgaaattagctcacgttaaaaccttacgagaatttggggcggatggtgtggcagtgattactgcaattacgcacgccgataatgtgcaagccgcaacaaaagcattacgggaggcaagtgatgaatacgcaaaatagtttaaagcaagtagcaacagcgacgatggtcggcacggcgattgagtatttcgataactacatttacgcaatagcagcggtattggtatttaaccatcaattcttccatgtagcagatccactttcagggcagattgcggcactttccactttagcacttacttttattgctcgccctttgggagcaatattgttcgggcatttcggtgaccgtttcgggcggaaaaatacttttgtgatgagcttgctgttgatgggcgtttccactgtggttatcggtttgttgccaacctatgacagcatcggtatttgggcgacaattttgctctgtttatgccgtattgggcaaggtatcggtttaggcggagagtggggcggtgcagcgttagttgcggtcgaaaatgctccagaaggtaaacgaggttggtatggtactttcccacaactgggagccccgcttggcttgttgttggcaaatggcgtattcttaggcattacggcaattttcgggcaagaagctatgactgaatgggcgtggcggataccgtttttatcttccgttatcttagtggcaattggcttatatgttcgcctaaaactgactgaagccccgattttccttgcggcactcaataaaccgcagccaaaacgcttaccaatgttggaagttgtcactacttatttcaagccgtttttcttggggatgttaatttgtattgcaggctatgtgctgttctacattatgattgcctttagccaaatttacgccaaatctgccccaacggtttcagaggcaggatacgcaatgggattaggactttccccgcaaatttttaccgctttattgatggcaagtgcggtttctttggctattaccatcgccgtttcgggcaaatatatcgacaaaattggtcgccgtatttggctcatttggacaaccgttggcgttgcgatttttggtttatccttgccgttatttctcgaaaacggtacaactaccagtctgttttggtttttattcatcggtatggggttaattggaatgggctatggaccattagcgagttttttacctgaactcttccctactcacgcccgctattcaggtgcttctttaacctataatattgcaggtttattcggggcaagtgttgcagcaatcattgccttaccgctgaatgctcactacggcttaaaaggtgtggggatttatttaaccctaaacgctgtgttgagcttggttggattatggtttatttcagaaacgaaagataaattactatcctaagatttgaggaattaaatacaatctattaagcggttaaattttacataaaattctactaagaatttaaccgcactttcctttacaagccaaatattttctctacaataccccacctaacgatttaccttgagtaaatccctgacctgaaatcagacaaaagagaatattatgacaacccaattcaaaccagaattactttcccctgcaggctctcttaaaaatatgcgctatgcgtttgcttatggtgcagatgcggtttatgcaggacaacctcgttatagcttacgtgtacgcaataatgaatttaatcacgccaatttgaaaatcgggatcgatgaagcccattcccttggcaaaaaattctatgtagtggtaaacattgcaccccataattccaaactcaaaacttttattaaagatttacaacctgtcatcgatatgaaaccagatgctttaattatgtctgacccaggcttaattatgttggtgcgtgaaaatttccctaatattgatattcatctttctgtgcaagccaatgcggtaaactgggcaacagtgaaattctggaaacaaatgggattaactcgtgtgattttatcgcgcgaactttcaatagatgaaattgctgaaattcgccaacaaatgccagatattgaactcgaaattttcgtacatggtgcgttgtgcatggcgtattctggccgttgcttactttctggctatatcaacaaacgcgatccaaatcaaggcacttgcaccaatgcttgccgttgggaatacaaaatggaagaaggcacgacggatgaagtaggcaacatcgtgccgaaaatcgatcctgctcaacaaatcgaagtgaaaaatgtagcaccaaccttaggcgatggcacagtaacagataaagtcttcctttataccgaatcacaaaagcctgacgaacaaatgacagcgtttgaagatgaacacggcacctactttatgaattcaaaagatctacgtgccgtacaacatgtggaaaaactgaccgcacttggtgtgcattctttaaaaatcgaaggccgtactaaatcattttattattgtgcaagaacggctcaagtttaccgcaaagccattgatgatgcagccgcaggcaaaccatttgatgaaagcttaatggatacgttagaatcccttgcgcatcgtggttataccgaaggtttcttacgtcgccatacgcacgatgaataccaaaactacgaatatggctattctatttctgatcgtcagcaatttgtcggtgaatttacgggcaaacgtaacgaacaaggtatggctgaagtagcagtaaaaaacaaattcttacttggcgacaatgtagaaatgatgacaccacaaggcaatattaatttcaaaattgaaaaaatgctaaatcgtaaaaatgaaacggttgatgcagcactaggtgatgggcattttgtattcttaaatgtaccacaagatattaacttaaattacgctttattaatgcgtaatttagttaataccaatacaagaaacccacattgctagtgtgatataaaacagaatttaaatcatacctaattaaacattactgttacttggcttgcgtcgtttgccgatatttttcgtatccttatgacgcaattttacttttttctttgcctctgtttttttcttttcttcacgtttttttttaatgcgtgccttttgttttttgctgacagatttcacttcgccatcttttggtggcttagtgcgaggttctaaacctgctaaaatgcgcgcctttaaaatttcctcagtataacgtttgattttacctagcaacttgtaatcatgcgcttcgacaaaagagactgccgtgccttttttgccagctcgcgcggtacgtccaattcgatgcaaataagtatccgcactatagggcaaatcaaaattcatcacgtggcttacatcatcaatatcaataccacgcgcagccacatctgttgcaaccaataccgtcacaatacctgatttcaatttatcaatggcattgttacgttgagtttgtgccatttcgccttctaaatatgcggaacgaatgcctcgtttacgcaatgtttcagaaacttcacgcgcatcttcacgacggcgaacaaatacaattccacgggttactttttcagtttcaataaaacgcgcgagcaatttgattttatgttcattgctgtctgcgtgataataccattggttgattttttttctttcacggcgacttggttccgcatctactttcacaggatcattcaacaaacgctccgcaaaatcgaccaataactctccttctaaggttgcagaaaacaacaaagtttgtttccgccaacgggtttcagctgcaattttttccgcatcttgcccaaatcccatttgtaacattctatcggcttcatcaaaaatcagcatttcaacggaacggcaatcaaaattttcttccttaatgtattgcaataaacgacctggcgtagccaccaccaaatcttgattggtattgaatacatcaccatgattttgatacgccacaccacctgtaattgtcgcaatatttaaatgggtgaactgcgctaattcttccgcttgttcagccacttgcattgccagttctcgggttggtgttaatatcaaaatacacggtggccctggtttacggcgtggataatccaataaatgttgtagcgcaggtaataaaaaagcagcggttttccctgttcccgttggtgcagagcctaatacatcacgctcttccattgcggcaggaatggcttccatctgaatagctgttgggcgggaataaccttttttctcaagtgcctttaaaagttctggagaaagatcgaattgttcaaattgggataaattcattattgtgcggttctttgttaaaatcgtcgaggattatacctgaaagtgcggtcaatttacgaaaaatttatgagcggatttacctttaaacaattccatatcaatcaagattcttgtgccatgaaagtcggcactgatggcattttgttaggtgcttgggctgatgtaaagcattgtaaaaatattttagatatgggcagtggcacaggattattgactttaatgttagcacaacgaactgaagaaaactgtcaaattcaagcggttgagttggatcccattgcagcaaaacaagcacaagaaaacatcaataattcagtgtggaaaaatcgcattcaacttactcaagcggatatacaacattttttacaaaccactgaacaaacctttgatttaattgtggcaaatccaccttattttgaacaaggtatcgcttgtaaaaatgaagaacgagaattggctcgttataccaagcaaagccacttaaattggttagaatgggctgcaacacgcttgtcggaaaatgggaaaataagttttgttttgccttatgatgcaggcaaaacgctcacaaaatccaccgcacttttttgcataaaacagacgaatgtcatcactaaaataggaaaaacgccccagagaatgttgcttacctttgccaaacaacccgaagttttaatgcaagatcaattggtaatttatgatgcggataatcaatacactgaagcgtttattgaattgactaaagacttttatttgaaattttaaaggggaaatcgtttcccctttaatcatacactatctaaaatacccttgcaacgtgaaagcacgcggtttcttcaccaataagcaaatgccaccgtgatgttctgttccgctcactcgggctaattcttcactatctacaacgtgataagccttcttgttttcggctaaataactcaatacctcgccaattttgtgtgacatttgcacggttgcccacaatcgaacaatactttcaggacgctctgcaaataaagctaaacaggcattttcaccgtaaaccttcatttcttccgcacggtttttcttaattttttcaggcgcacgaggagaaagcgcaccagttttcttttctttcgttttataaaccgtacccgtactttttattgtcacttgaaccttaggttgttctgtatttttatttgatggtgcgcgagataaagaaagttgcttaattctagtttctttcacttcttgtttatcacgaggaaaacgagatttttcgtttctatttccattaaatttatcattaaagtgcggtcgattttggcttggtttttctctgtatttttcacctactgagcgttcttgaaaggttttgcctgcggattgaaaagacggtttgcgtttgtcgttcatagggtttccctgagtaaaaatggctgttttttagccaaaaaatgctaaaatttgtgagcattataacgaaaaaaagccttttttctattaataagcacgtgaaatattgtaaactaacgcactagtctttaatcacgagatggattatgttaatcaataaaaccaaacgagctgaacaaaatttaaataatttgccattccttgctttgcaagctgagcaaattgaatttttgggtagctcggctgaatttaaaactcaaattattgaattaatcagaaacgcaaaaaaacgtatttatgtcaccgcactttattggcaaaaagacgaagcgggacaggaaattctcgatgaaatttatcgcgtgaagcaagaaaatccacacttggatgtaaaaattctcatagattggcatcgtgcacaacgcaatttattaggggcggaaaaatctgccactaatgcagactggtattgcgagcaacgccaaacttatcagttacctgatgatccgaatatgttctttggcgtgccaattaatacgcgagaagtttttggtgtattgcatgtcaaaggctttgtatttgatgatacggtgctttatagcggtgcaagtattaataatgtctatcttcatcaatttgaaaaatatcgttacgaccgctatcaaaaaatcactcatgccgaattagctgattcaatggtaaatttcatcaatgattacttgttagatttcagtgcagtttatccacttgatgtgaccaaccgccctcgtactaaagagatccgcggtaatattcgagcttatcgtaaagaccttgctcaaaatggagaatattcattaaaaagtgcggtgaaattaccgaatgttttaagcgtatcgccactgtttggcttaggcgcatcgggcaacgaattaaatcaagtaattgaagatttattcttacaagtacaagaaaaattggtgatttgtacgccatattttaatttcccacgcacattgcaacataaaatagcaacattattggaaagcggtaaacaagtagaaattattgttggcgataaagtcgcaaacgatttttacattccaccagaacaaccattcaaaatggcgggggcattaccttatctttatgaaagtaatcttcgccgtttctgtgaaaaatttgagactcaaattgaaaatggtcagcttgtggtgcgtttatggcgtgatggcgataatacctaccacttaaaaggtgtgtgggtagatgaccgttatattttattgacgggcaataatcttaaccctcgagcatggcgtttggatgcagaaaatggcttattaatttacgatccacaacaacagcttttagcccaagtggaaaaagagcaaaaccaaattcgccaacatacaaaagtattaaaacattactctgaattagaagaattgaatcaatacccagaaccagtgcaaaaacttttgaaaaaatttgcacgaattaaagcagataaattggtgaaaatgattttgtaattataagaaaagttttatgtttttttcttaaattcgcttccagtattaatctgataaattttgtggcaatcgttctaaaatggctttccaataggttgaagaacgtaaattatgtttacggatgcaatccactactgcatctgcatttccctcaagacaaatttgttgcatttctaaataaaattgctttgttaattcacggtgttttttttctttaaaaaataacaaccctattcgctgataaacaccttttaaactattgaaaattaaacgataaaagggtttgttggcaacaacagtaaattgacgaaataattggtaatcaaattctgtgtaatcttgtgctgtgttttgtaattgctctaattcagcaaaaagtgcggttgatttttgaggggaattttttactgcttcataaatgtaagattccgacattttactacgtaaagagagcatattatcaataattaagggcgcggactgcatatccaaagcaattagggtttcaataatattcggccctgcagcatcccaaatattatttactttggtgggtttgccgtgctgaattgttagccaaccatcacgagccaaacgttgtaaaacttcacgtagggtggtgcgagttacaccaatcttatcggctaaatcacgttctgatggcaaattactgcccgaaggaaaaacatcttgccaaatactctttacaatatattcctctgctaaagctgctggactttgggcttttaaaatgtcgttattgttttgcattacaattaaaaatcagataaaaatcaaaaaaaatgcaattttataaaaaaattacttggtttttattatcctttaaagggggatatattacaatgttcgcgtgataaaaataatggagttcactatgacaaacattcaggcttttatgaaaaactttcttggggcaagtccagaatggtacaaacttgccattgtggtttttcttattataaatccaattgttttcttttttattagtccttttattgcgggttggttactggttgcagaatttattttcacattggcaatggcattaaaatgctaccctcttcaaccaggtggtctattagcaattgaagctattattattggaatgacaaatgccaaacacgtcaaagcagaaattatggcaaactttgaagtgatcttgctactgatatttatggtggcaggtattttctttatgaaacaattactgctttatgtatttactaaattacttgtcaaaattcgttctaaaattgcactttctattgccttttgttttagtgctgcttttttatcggcttttctcgatgctttaacggttgttgctgttatcattagtgtcgcaatgggattttatggtgtgtatcacaaagttgcatcaggcaataatttaattgatgcggttgatatttcagacgatagaaaaattattgaacaacagcacgaaatcttagaaaaattccgtgcattcttacgtagtttaatgatgcatgcgggtgtaggaactgcactcggtggtgtaatgaccgttgttggagaaccacaaaacttaattattgcagaacaagcaaaatggaactttatggaatttttcctccgtatggcacccgtgactattcctgtgtttatctgcggattactcacttgtttcttggtcgaaaaattcaaattatttggttatggcgagaaattaccagacgaagtgtggaaagtcttatcagacttagatcgcactaattcagaaaaaatgtctaaacaagataaaattaaattaggtatgcaagcgttaatcgcaatttggttaattcttggattagcattccatcttgccgcagtcggtttaattggtttaagtatcatcatttttgctacgtctttcactggtgtgacggatgaacatactatcggtaaagcctttcaggaatctttaccctttactgcattgctcgttgtattcttttctgttgttgcagtaattattgatcaaaaacttttttcaccaattattcacttcgttctttctgcggaagaaaatacacaacttgctttattctatttgtttaatggcttgctttcttctatttctgataatgtatttgttgcaacggtttatattaatgaagctaaagctgcactgacaaatggagtaattgcaccgcatcaatttgaattgctttctgttgccattaatacaggtacaaacttaccatcagttgcaacaccaaatgggcaagctgctttcttattcttattgacttcatcaatttcgccattaattcgcctttcttatggcagaatggtttatatggctttaccttacacgattgtactttcaatcattggtttactggctattgaatttattttaccagctgccacaatttggttagcaagtttaggtttaattttgccaatttaaggagaaaaaatgctcgcgctattaaaacaattttccgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcattattgcattacttcaacctcttgctttcatacttcgattaatcgccttggctttaggtttattcagcagtattaagggcttattgatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaactaaaaaaatacggtgaaatttcaccgttttttttattacattaaaatcaaccgcactttattcaacggtaactgattttgctaagttacgaggttgatctacatcagtgcctttaattaaagccacataataagaaagtaattgcattggaatggtataaaaaatcggtgcaacaatatcattgacttttggcatcgtgatgattttcattccttcacttggcgtaaatcctgcttctttatcggcaaatacgtataattgaccaccacgagctcgcacttcctcaatgttcgattttactttttctaataattcattatttggtgcaacgacaatcactggcatatcagcatcaattaacgctaatggcccgtgtttcaattctcctgccgcataggcctcagcgtgaatataagaaatctctttcaatttcaaagaagcctctaccgcaattggataaaacgcaccacggcctaagaaaagcgcatgatgtttttcagcaaaatcctctgctaaagcttcaatttctctatcaaaggctaacgctttttcaatttcagcaggtaaagattgcattgctttaataatttcacgttctttttctacagaaatatgacctttaactttaccaagtgccgttaccagcattaataatgcagcgagctgtgtcgtaaatgcttttgtcgatgccaccccaacttcaacaccagcacgagtcataaatgcaagatctgattcgcgtacgagcgaagagccagcaacattacaaattgttaatgctgccatgtagcccttttctttcgctaaacgaagtgcagctaaagtatcggctgtttcgccagattgagaaagggtaatcaataagctatttggacgggtaacaaatttgcgataacgaaattctgatgcaatttcaacatcacagctcacgccagctaaagattcaaaccaataacgcgccaccatacctgcattataagatgtaccacaagcaacaatttgaatatgctcaactttttctaaaatgccttttgcaccattaccgattgaatcaacaatcacattttcgtgattaatacgcccttccattgtattaataagtgcagttggctgttcgtaaatttctttctgcataaaatgacggaatttacctttctctgcagcgtcattttcaagattagactcgtgaatttcacgtttagccttattaccgtgagtatcataaatatcaactgtacgacgtgtaatttctgcaatatctccttcttctaaaaagataaaacggcgagtaacacttaaaagcgcaagttgatctgaagctaagaaattttcaccgatacctaagccaatcacaagtggactaccagaacgagctgccactaaatgttcaggatgacggctgtccattaccaccataccatatgcgcccgtgagttgttttaccgatttctgcacagcctctaaaagggaatccgtgctacgcatttcccattcaacgaggtgagcgatcacttcagtatctgtttgtgataaaaagacataaccacgagattttaataattcgcgaagttcttcgtgattttcaataataccgttatgtactacagcaaaagtacctgatgaatgcggatgcgcattagtttctgatggttcgccgtgagttgcccagcgagtatgtgcaattcccgttccaccaattaatggtttttctgatacggcttcatctaaagctttaactttgcctaaacaacgaatacgttgtaattcattttgtttattgattactgcaacaccagctgaatcataaccacgatattctaaacgatgtaaaccattaattaagatttccgctacatctcgttgcgctactgcaccgacaataccacacataagttttccttatttatcctattactaagtttgtttttacatttgccacgcgtttacacaataaaaaaaaccctgcgcaatcgacagggcttcatttcattgatgttatcaattatttgattgcatcttttaatgctttaccagatacaaatgctggcactttagatgctgcgatttggatttcagcaccagtttgtgggttacgaccagtacgagcagcacgttcatttactttaaatgtaccgaagccgattaattgtacaggctcaccttcttttaggctcgcagtaattgcatctaaagtcgcttctaacgctgctttagcttgttttttgtttaactctgcagcgtttgcaattgcatcaattaaatctgttttgttcataaatttgtaccttctgttaaataaaaagtttgattctttaaaagtatctttgcgaatttgtcgcaaaaactgtgcaaaggataatctaacttgagatgaattaaaagcatgatttataaaaattgtgacaaatctcacgttattgatgaaattctataccaatgttagatataccctcagtccgaatttcattttttaaagctaaaattaattcaatatcacgtttttcacattctttaagcaaacgataaacttgccattgcacatcaagttctgtttgaatatcttcattttcttttagtttactttctgaccaatctcgtccagtttctgtttccaataatgcccttactgttcccaacgaaattaggcttatttccaccgctttttctaaggtttcgcccgcaataatggcgtgtaaaatttcagctaaagcctgacaggcatctaacgctggcacaacaccaaaactatcataatcattcacatcaggaataatgctttctaatttctccaactgattttcaaagttgattttgacatctttaattgttaaatattcccacaccaaattgagaatattttgatacgttttggtttcaacgctaagctcgttcatttgacagaacaatttaaaatttggtgccatacgttcacataaagcagccataaaagtaagatgttgccaactgtctaagttttctaagcgtttatgaatcggatttcgcatcttatttccttaattcgtaagagttggaatatttattaatcgcatttatgttccgctttacaaagttcaagcgtcacatgaattaatttgcgagcgatagtacccgttggcggtaattctggcaagggttgatcataagaaaaccattgtgcatcatgaatttcactttcctgcaatgttatttctccgctttcataatcagccagaaaaccgaccatttgagaatttggaaatgcccaaggttggctaccgaaataacgaagattttttattgaaatccctgtttcttcaaaaacctctctctgcaccgcttgttcaaatgtttcccctacttcgacaaaacctgcaagcgtcgtgtatattcctccgttaggactataatgtcgcttatgatttgccaatagaatttcgtgaccacgacgaaccgcaacaataattgatgggcaaatcacaggataagtttgatacccacagtgaatacattgcactgcaagttcatcttgagtttgttgtgttttatgaccgcactttccacaaaatttatgggttttcagaaaatgattaatttccacacctcggcttaatatatggaattcatcctctggcagtgaaagcaagttacgcaaactcacatattctcgttcatcactttcttgctcagccacaagccacaacggatgatttttccattctccaatttgcattgcctgtaatccttccaaatcgatatctttagcgataccaaaaggcaattcattattcactaaatacagattagaaccttgtgtaagcaaccaataaccaaaatcatcttgttgaagtattttcattttttctccataaaaataaccgcactttcaaaagtgcggtcattataaatcttcttttataactcactaataataagaatgttcgccacgttgatgctcagttatatcttttgcaccttttaattcattcgggaataagctaacaagttgtttttctacgccatcttttaacgtaacatccaccattgaacaaccgttacagccaccaccaaattgtaaaactgcgtaaccatcttcagtaatttcaattaaggttatacgtccaccgtgatttgcaagctgtgggttaatttgagtttgaattacatattcaacacgttcaatcaatggcgcatcatcagccaccttacgcattttggcattcggtgcttttaaggtcagttgcgcaccaagctcttcggtaacataatcaatttctgcttcttctaagaaaggcaaactcacttcatcaataaatgcagaaaaagtattatatttcatttcaatatcgctttcttccacggcattcggggggcaataagatacgccacattccgcattaggcgtacccggattaacgacgaaaatacgaatattcgttccttcttcttgggtgtctaaaagttttcgaaaatgcgcttgtgcggcatcagaaatagcgatttgctgggttgcttgttccataattatgtcctaaatacttgagagaaagtatcgggaataatacgcttatcgcgcttttttttccagtgctttatattaagctcgtgccagcccccacacttgaatctcctccacacctaattttcgcaacaattttgagatttcattgagtgtagaaccagtagtaatcacatcatccaccaacgcaacacggcgataaggaaattcatttttcgaaacaacaagagaaaaggcattttttaaattctgacgacgatcttttgcactcaaaccacgttgagtataggtgtgtttcacacgctttacgatattgctcaaattaggaatatccagccagcgacttaattgccgagataataaatctgcctgattataaccccgtcgccactgacgaaaatgatataaaggcactggaatgattgcttctggcaatttaagttgatgcgttcgtttagcatcacgcaccgcaagatataaaagccgagctaaagtgcggtcaatccaaaattgattttgaaatttaaaacggtgaatcaatatcgaaagaggttcaatataatgcccaataatgaccatcttatcccaacttggttcttgtttaagacaattaccacaatgctgcgcataatattgcaattccgcaccacaatgaccgcaataaggaaaagatttaatttgtttttggcaacctgaacatagcccattttttgcaatatgaagattgccacgacagtggatacagcgaaaattaaaaaaattcatcgtctaaaaaagttattttttccccgcacttttttgtttcaacgcctctaacgtttctcctgcttttaaaatatgcggcgtgacgaaaatcacgagctcacgtttttgatgtcgttcactttctttgctaaataatcgtttaataacgggtatatcgccaagcaatggcactttatcttcgcttttcgtgattgtgtcgtgaaatacgccgccaagcacaatggtttccccatctttggcaaaaacctgagtattaatttcttgcttatcaatagaaaccacctcattttgtccataagcgacacgagaaccaggggaattttgacttaccaataaatcaagtaagatattgttatctttagaaatatgtggcgtcacttccaaaccaagtactgcctcacgaaattccacagattgcgtatcgttacgagtattactcacgatgtaaggaatttctgtcccctgtttaatgctcgcacttttcttattggtagtgagtaagcgaggacttgcaataatttctacattattttcacgctccaacgcactcaattctaaatcaagcaatcgcccattaattttcgcgacttgtaatgctatagagccagcaggtgtcgtcgttgtcgcaaaatttacattaagattatccgcaatattttcaaagctattgcctgtaaggctgcccgcaactcgtcttgcattttcagttggattaaaaatcccccaccgaacgccaagttctttcaaactctcatccgtaattgtcacaattcgcgcttcaatagcgatctgttcaataggcttatccatttcagcaatcagttttttgatattttgcacaaaacgaggttcatcctgaataaccagcaaattactgcgatcatcaaaggtaatgctccccgcagaagaaagcaaagatccacttcctgttgttaaggatttcattaattcagaggctttagcaaaatgaagttttaccgtgtggctgactaagtgcggttcatttgtcgtaagatttcctgcaacttgacctttgccagattgactgccgtttaaataataaaccccatcatctttattcaaagtaagatgcttactttttgcgattatttttagcaaacgtggcatatcaatattgtttaatttcaaagaaatattgccttctaacctctcacccatcactaaattcacatcttgttgaaaagctaattgctccagtgtttgagctaaaggtgcttgcgataaacgaataaaaaaacattcgttatctgttttaggattagcaaaaacgattaatggcaaacaaaaacacactaaaaaataaccgcactttaaaaaatatttcttcataatcttcctttaaaaacttaattttttccattcactactatcacattgctctccgagcttacgcataaattgaacattgttttggttgattttttctacaatatagccctcttgagccacatcaacgccctctaaaacgctgtaaatttgcaaaccttgatcttgcaacaaggcaaaggctttatctttagaaatcactacgcccaccaattttaaagcgttcaaaggaatttcagccgcttggcgattttcatccgctccgcatagattattaggtacatctgaggaaattatttctgtctgctccattactgtttgtgcgttatcaaactgagaacggttacgctgtgttttatcgaaaggatcttgtccccaactgcaattcataaaaaataatataatcaggaaaaaccaatgtttcattttgtttccttatctagctgaaaaatgatctcggtttgcaatgggttgtcttcgggtttgataaactgcaagcgactcactgaaagctgtgacgaattagccaaaagtgcggttaaaaatgtcttcgttttctcaaaatgacctgtaagctgtaaatgcaaaataggcttttgccccatttcccaacgtaaatgctgagataaaccgttacgcgcagctaaacgttgaatttgtttattcaaaggaataatttgtgcagccagttctggagaaagttttcgactttccgactgctgctgtaaagaagttaaaattttctgttgatgcaacaattctgaacgtttcaccgctaactcattttcaatttcatggaaacgtgaactcccctcgatataatctaaaacggggcgaaaaatcaccgcacttaatagcaataaaaaggttaaaccgtgcacataaaaaggctgacttagccattttccaaaaggagtaaaaggatcgttaaaaaaagctttcatttttccgccccttgttccacatcaaagtgaaaaaacaatgtatcttgttcaggttgaacctgacttaatttcacattgggaaaatgtttctttaaaaattgatgaatcagttcaaattctgtttgatcttgcgcgttaccttccaaacttaagttattggcatcttgtttaaatttattcagttctccttgttgaaaaggtaattcacttagctgttgtaaactcttttttacttgctcgttgggaatagatgtcaaaacttcaccaactttcaccgcactgcgtaactgatcaatttgcatggtagttttgtgaagttgctgattaagttgttcaaaagatgtttgctgcgcttgcaaattttgtttctgttgttcaatcaaattgctaaaagccaacattaaattaatagcaagcaagataaataaagcgatataaaaagctaaacgacgtaaacgcttttgatgttgataagtacgccaaggcaataaattcatcgacatttaaccacccactttttgttgatgtaaatctttttgccatagcgcgttgccaagcgcaataaaagggagttctgtttctactcgctgccagttttcgggtaatggtgtatgacttgagggaatttgataaacaaaaacttgttcaagttgtccttcaaaacgttcggtaaattgttcataaagtgcggtcaaattttcgtgagattgtaaaatttgcgattgctgcgatctttcacagatcgccaaacaatagtcatcttcttgaaataaaaataaggtattttctgaccgcacttgttcattcaacaaatactgaaatgcacgcaaaatagcatttgacgcaacatccaatacattaattttaaatggctgaaaatcttgcaaataagtttgagcagtacttttacgaattgcagtaacgtctaatcgaaaaccttgctttaacgaggtagaacgataatcaaaccataattcatttaaagaaataggcagctctttttcaatcacaaatttacattgttgatgacattcttgcgcatttaacacttgtggcaacattaatactttcgaccaagttaagtgagcgggaatgcttgccacaaactgtaaaggaaaggttttcccttgatattgtgtttttagctgttgtaaaaaacgatttttaaaatcacgatcattaacaaaaatttgataactttgtggctgttcaagatcatcaaaccacacaaaatcaaaataaccctgcttacgatgaatgccgatttgtaaagtgcggtaatttttcagggagaattgcatattctttcctattctttaaaggctgaatcttttatacttaacaactaaatcataggtctcttgacaagaatattcattaaccaagcgagaattttacgatgcggatcgcaaaattaatattaaacaccctattaactttatgtattttaggtttagtggctggcggaatgttgtatttccacctaaaatcggaattgccctcagtagaaacattaagaaccgttgaattacaacaaccaatgcagatttatacggctgacggtaaattaattggcgaagtgggcgagcaacgccgtattccagtgaaattagccgatgtgccacaacgcttaattgacgcatttttagcaacggaagacaatcgtttttacgatcatcacggattagaccctatcggcattgctcgtgcattgtttgtcgcagtgagtaatggcggtgcatcacaaggtgcaagtacgattactcaacaattagcgcgtaactttttcttaaccccagaaaaaaccattattcgtaaagcccgtgaagcggtgcttgcggtagaaattgaaaataccctcaacaaacaagaaatcttagagctttatttaaacaaaatctttttaggctatcgttcttatggtgttgcagcagcggcacaaacctatttcggtaaagcattgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcggcagcattagaaaaaggcttaacgctttctagtgtattacaagacagcccgatttctattcaaaaaccgggacaaaaaatgtggcaaccgaaaaactcgcctgatcgttatgatggcccgatgcgtttacgcgtaggattaggtcaatccaaaaatatgattgctattcgtgcgatccaaacagcaggtattgatttcacagcagaatttttacaacgttttggttttaaacgtgatcaatattttgctagcgaagccttagcacttggcgcagcctctttcacaccattagaaatggcgcgagcttatgcggtgtttgataatggcggtttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagagtgccttaaaaccaacagatgacagcaccaatggcgaagaattagatcaacaacctgaaactgtgcctgaactgccagaattacaatcaaatttcaccgcacttaaagaagatgcgattgatttaatggctgctgcaaaaaatgcctcgtcgaaaatagaatatgcgccacgtgtcattagtggcgaacttgcttttctcattcgtagtgccttaaatacggcaatttatggcgaacaaggtttagactggaaaggcaccagctggcgcattgcacaaagtattaaacgtagcgatataggcggtaaaacaggtactaccaacagttcaaaagtggcttggtatgcgggatttggtgcaaacttagtcactacaacttatgttgggtttgatgataacaaacgagtacttgggcgtggagaagcgggtgcgaaaacagccatgccagcttggatcacttatatgaaaatggctttgagtgataaacctgaacgtaaattgccactgccgccaaaaattgtggaaaaaaacattgatactttgacaggtttgctttctccaaacggtgggcgcaaagaatattttattgtgggaacagaaccgacacgtacctatctttcggaaatgcaagagcgtggttattacgttcctacagagttacagcaacgcttaaataatgaaggcaatacgccagcgacgcaaccacaagaactcttctaaaaatgaccgcactttagtgtgaaatcgggcgagtcaattggctcgccttcgttataaaacaaaggatatattatgctgagttatcgtcactcatttcacgcaggcaatcatgctgatgtcttaaaacatatcgtcttaatgcttattttggaaaaccttaaacttaaagaaaaaggctttttttatttggatacgcactctggtgtaggtcgttatcgtttatcttcaaacgaatcaaaaaaaacgggggaatataaagaaggtattggacgcttgtgggatcaaacagacttacccgaagatgttgcccgttatgtaaaaatgatcaaaaaactcaattatggtggcaaagaactacgttattatgctggctcaccgttaattgctgcagaattgttgcgcccacaagatcgcgcactattgaccgagcttcatcctagcgattatccaattcttcgcaataattttagcgacgacaaaaatgtcaccgtaaaatgtgacaatggttttcaacaagtcaaagcaacgcttccgccaaaagaacgccggggcttagtactcatcgatccgccttatgaattaaaagatgattatgatctcgttgttaaagccattgaagagggctataaacgttttgccactggcacttatgcgatttggtatcctgttgtattacgccaacaaactaaacgtatttttaagggtttagaagcaacgggaattagaaaaattctaagaattgagctcgctgttcgcccagatagcgatcaacgaggaatgactgcgagcggtatggtggtaattaatccaccttggacattagaaacccaaatgaaagaaattttgccttatctcacaaaaacattagttccagaaggtactggaagctggactgtcgaatggattacccctgaataaccgtctcttcccattctaaacaccactaaatttcaccgcacttgacttcaaaagtgcggtgaaattttctgagattttaaatccccaaaatcattaaccctactgttcccaaaagcccattttttcgctagaatgcacgcaatttttgacttaataaaggataacattatgtttggaaaaggcggtttaggcggcttgatgaaacaagcccaacaaatgcaagaaaaaatgcaaaaaatgcaggaagaaatcgcacaactagaagtaacgggtgaatctggtgcaggtttagtgaaaatcacgattaatggtgcacataactgccgccgtattgacattgatccttctttaatggaagacgataaagaaatgttagaagatttaatcgcagctgcttttaacgatgcggtgcgtcgtgcagaagaattacaaaaagaaaaaatggcatcagttaccgctggaatgccattaccaccaggaatgaagtttccgttttaatcgaacacttgtcttcccctgcttgcgagggaaggtgtcgcaaagcgacggaagggggttccccctaagtcttcggtattcccccgtaaatagagggagcggaaagtagccttatatttcatctcaaattatgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagctatgtctaaaattggtcattgttcacaatgtcgagactttacggaagaagacacttgcaacatttgcaataatccacgccgtcaaaattcaggtttgctttgtgtcgttgaaatgcccgcagatattcaagcgattgagcaaacggggcaattttcaggacgttattttgttttaatgggacatttgtctccacttgatggtattgggcctcgtgaaattggcttagatttactgcaaaaacgcttagtagaagaatctttccacgaagtgattcttgcaacaaatccaacagtggagggcgatgcgacggcaaactacattgctgaaatgtgccgccaacataatatcaaagtgagtcgtatcgctcacggtatccctgtcggtggtgaactagaaactgtggacggcacaacgcttactcactcttttctaggtcgtcgtcaaatcgactaatcttctcataccattatgcgtttatttatcgccgaaaaaccaagcctagctcgtgctattgcagatgtgctacccaaaccccatcaacgtggggatggttttattaaatgtggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactaatccatcaagcggatacacttgttaatgcaggagacccagatagagaaggacaattacttgtagatgaagtcttcagttatgccaatttatctgccgaaaaacgcgataaaattttacgctgcttgattagcgacctaaatccaagtgcggtagaaaaagcggttaaaaaattacaacccaaccgtaattttattcctcttgccacatccgcactcgcacgagctcgtgccgattggctttatggcattaatatgaccagagcttataccattcgaggtagacaaactggctatgatggcgtgctttctgttggacgagtgcaaacccctgtgctaggtttaattgtacgtcgagatttagaaattgagcatttccagcccaaagacttctttgaagtacaggcttgggttaatccagagagcaaagaagaaaaaactccagaaaaatcaaccgcacttttcagtgccttatggcaacctagcaaagcttgcgaggattaccaagatgatgacggcagggtgctctctaaaggattagcagaaaacgttgtaaaacgtattacaaatcaaccagcagaagtcaccgaatacaaagacgttcgtgaaaaagaaacggcgcccttgccttattcactttctgcgttacaaattgatgcagcaaagcgattcggtatgtccgctcaagccgtattagatgcatgccaacgcctgtatgaaactcatcgtttaattacttatccgcgttctgattgtcgctatttacccgaagaacattttgccgaacgccacaatgtattaaatgcaatttcaacccattgtgaagcttatcaacgcttaccaaatgtcatttcaactgaacagagaaatcgctgttggaatgataaaaaagtagaggctcaccacgcaatcattcctactgccaaaaatcgtccagtaaatctaacacaagaagaacgtaatatttacagccttatcgctcgccaatatttaatgcaattttgtcctgacgcagaatatcgtaaaagtaaaatcacattaaatatcgctggcggtacttttatagcccaagcgcgaaatttacaaacggctgggtggaaagaattgttaggcaaagaagacgacacagaaaatcaagaacccttattaccaatagtaaagaaaggtcaaattttgcattgtgaacgaggagaagtgatgagtaaaaaaactcagccgccaaagcctttcaccgatgcaaccttgctttcagcaatgacgggcattgcgcgatttgtgcaggataaagaactcaaaaaaatcctgcgagaaaccgatggattgggtacagaggctactcgtgctggcatcattgaattactttttaaacgcagttttttaactaaaaaagggcgaaatattcacagtacagaaactggaagaattttaattcaggcattaccagatattgccacccaaccagatatgacggctcattgggaatcgcaactcacagacattagtcaaaaacaagcaacctatcaacaatttatgcataacttgaatcaaatgttacctgatttagtccgttttgtagatcttaatgcattaagacaattaagccgcattaaaatgattaaatccgatagagtgaaacctaaaagtgcggtaaaaaaatcgagtaaatcaaacggtgaaactgattaaagttaaaccaattaatattttttttatgcaaagcacttgcgagaaaattgaattttctataacattcacgaccagttttcttgcaaaattgcaaattagagagaaaaaatgtatcaagttcttttatttatttatgttgttgttgcgattgccttgatcgggtttattctcgttcaacaaggtaaaggagcgaacgctggtgcatcttttggtggtggcgcatcaggtacaatgtttggctctgctggtgcaggtaactttttaacacgtactagcgcgattttagcaaccgcattttttgttattgctcttgttttaggtaatatgaattcacataaaggcaatgttcaaaaaggtacttttgacgatttatcacaagctgcagagcaagttcagcaacaacaagcagctccagcgaaagacaataaaaatagcgacatcccacaataaaataggattagcataaaaattaaagctctggtggtggaattggtagacacgctatcttgagggggtagtgaccacaggtcgtgcgagttcaagtctcgcccagagcaccaaattaaaaatatacagcactaaaagcattacaaagccttgattctactgaaatcaaggcttttttattccctatactccactataaaatactatcgaaccttagaatcttagtaatagacttaataatatattcacgctaaggcaaaaaaatctattactaaaacagcatagagacttgtaaatactaggattaacgcctagtttgttatattactaagtagggctattttatggcatacttaacaaatccgctttctgacgcccaaattaaaaaagcaaaactgaaagaaaaagattgctcctacttttacaaacgattcacgaatacatccataactaaaaggactaagccctgtagattacagagcttagtccttgatttcatagtctaactttttcaatgaaaattattttttacattcaaagtgcggtattattccgcattgtttttcgatttaataatggcgtaaaccacacctgttgataaagcaccaatcgcaattgcaccaagatatttcaacggctcagatacaaatggaatgacaaataatccgccgtgcggagcttgtaaggtaatatttaatcccattgaaatcgcaccagccaccgcaccaccaatcacagagctaataatgactcgaattggatctgctgccacaaatggtaatgcaccttcagaaataaaacataaaccaagaacaaatgatgctttccccgcatcgcgttggctaacggtaaatttattgcgagcaatccaagtcgcaactgtcataccaattggaggaaccatacctgcggccattgccgcagccattggtgtataaacttgggaggcaatcaatccaacagaaaaagtgtacgctgctttatttactggtccgcccatatcgatacacatcattgcgccgataattacgcctaacacaatcgcattcacttcgcccattgaagtaagccaattacttagctctttcataatttcagccactggtggattgatgaggtaaatcatcgtcaaaccaacaatcatcgaacccaagagcggtaaaattaaaatcggttttaatgaagtcaggcttgctggcaatcgaataatcacatttagccctttcaccacatagccggctaagaaacctgcaataataccgccaagaatccctgcacccgcttcacttgccagcatccctgcaatcaaaccaactgcaagtcctggacgatcagcgatagaaaatgcaacgtaaccagcaaacacggcaatcattaacttgaacgccacaccactaccgatattaatcaacatattaggaagatcttgaaaaactcctgtattttcaattacattaaaactgaacataaaggaaatcgcgatcaacaatccaccagcaaccactaacggtaacatatgagaaacaccagtcattaagtgtttgtacacaccttttttctcacggctttcttctttcgttcccgcattatttccaccatcaaaaattttggcttctttaaatgccttatcaaattcttgctcagttttcttcaaggctaatcctgttgaagtgcggtatattggtttacctttaaatttatctaaaggcacgtcaatatctgctgcaacaaataccaaatcagccgccgcgacttcttctgcagtaatttcattgccagccccaacttgaccacgggtttcaacttttacattccaaccttgttttttcgcataggcttcaatcgcttcggctgacataaacgtatgtgcaacgccagttggacaagccgttaccgcaacaatattttttacaccagaaacacctgtaaaactcaccgcacttttcggtgcaacataatcagccccattcgctaaggcatttgccaatgttacttcaggagaaatcatggcgatagcttcgccgataataaagacttttttaccaactaacgcagggttatttggtaatacagaaccaaatacaagaacaagatctgcttcggctggtgtttctacaatagagacatttgctttttgtgcagctgctcgaaaaacttcatgtaataaataggctttcgcatcgcctacattagctgattgggttaaaaataacttcatactatccttcaatcatcgttatttgtactttttctaaaatggggtcaagtaaactcaaatcactcacaccgacgttactctgagataccgcaaaagcggacacagccgtagcaaaagctaaggtttctgttttcgataaacctttttcaaaaccatagattaagcctgctaccattgaatcccctgctccaacggtactcacgacattttcacattttgctggttcggctttaagcacgccttcattattaatccataaagaaccttttgcgcccattgaaataatcacgttttcaatgccttccgctttgagttgctgtgcagcggcaataatttcttcaagactatttaatgaatgaccaacccaagcctcaagttctcgatgattgggttttactagccaaggtttcgcttttaatccagcggtaagcgcagcattgctactatcaagcaccactttaacgccagcttgatgaagctgatttaaccaatcagcaaacaattcaggagacacacctcgaggtaaactgccacaaactgcgacaatgtcataatctaaacaataagccaaagaatccgtcacaaattgttgccaaatttgtgggcttatttgatatcccaagaaatttaaatctgtcacatccgcttcagtctcggtaatttttacattgatacgtgttttgccattaacacggtggaatttatctttcaaaccgtgctgattaaacatttgctcgaaatcagctgaattatccttgcccaagaaaccgcctactgcaacattaacgcctaaatcttttagtacttttgcgacattaatgccttttccagcagggaataagcccaatgtttctaccgtatttacttcgccaagttgaatacgatttaaacgcccaactaaatcataggcggcatttaaggtaatggttacgacgcttgccatactattcccctaaacccgattcgatcacagcgctgattccgtcaatagcttgttgcgcttcttcgcccgtcgcaacaaaacgtaaacgagtccctttgactacgcctaatgctacaattttcatcaaacttttagcactgactaattgagaattacgatcaaggttttgaactgctacggaagcattatatttcttcacttcatttaccaatattgcacttggacgagcatgcaaaccttgctcgtttttaatcacaaatacggcttcaatggcatttgccggcaaattatcatcttctgttaccgcaggtgtgtgaatttgatcgcccataatctcaatggtatcgggttcagacggtggcactaccgaaacattctcgcccaagccattggctatcgctttgcccaatgattcaattgcttgttttgcatcttccccctctgccacaaaacgtaaacgatgtccttgtgttacaccaagcgcaacaatcttcatcaaactttttgcgctgacgacttcactttcacgagtaagattttgcatggttattttagaagtgaattttttcacttcattaaccaaatttgcacttgggcgtgcatgtaagccgtgttcattacgaatcgtaaaggttcctacaacagcaccttctacagattgagtttcaacatcactcgatgaacccaaaagtgcggtcaaaatttctgttgaatttccattgagcaaggttgtttggacatcgtcatctaataaacgcgccaaagttggattaatttgatcaccgacggctgaaacggttatcacgccttttacggccttgccattgtggctaaaaatcgttttggcacgactaaatgctaaggcatttttcacatttcctacgacagagtccgttacccataaccctttgccaagtggtaatgccgcattatttatcacttcagaaataaagcgattttctaccgcactttgcacctgtaattgccccgcattaatcgcaactaaagttaataaactttgggtatttacatctaaactgatattggcagcaggaatttcaaatggatcaattgtctcgcccattaaaatcgcgcaaaattcagccacatcagttatttttgctaattttgctgcagtatcttcatcgctcaatacatgggttagttggcgtaataaggacaaatgctcatcagatcgcgccgcaataccaatcacgacataagcaatatttccttcgccccattctatgccttgaggaaattgaaacacttgcacgcccgttttctttaccatcaaacgagtatccaaggtgccatgaggaatagcgatgccattgcctaaaaaggttgaggtttgcagctcgcgcgctaacattccttgcaagtaaccattttcaacattgcctgcttgaaccaatgcggacgctgccatttcgatcgcttgttgtttatcaattgcattagcatttaaatgaatgttgctttccgaaagttctaacattcttgctccttaataatttaaaaagaaagctgcggatgaaacaaatcgaccagcagcttattgaaaaacaattatttagatgtacaggctttcagcagcgcttcactaccttgcacaatatattcatcattttctccgcgcgcttcgcctttttgtaaatcacgcatcgcatcataaataccttgagccatactttgcgaatccactttttcccaacaatttgcgctcaaacgtttaaggttcgcttgcaatgcttccgcatgtaacacgccgctataataggcatatacatcagaatcatggccgccagtgtaaagtttatcctgaatttgtttcactggaactaaaatacggcctaaataccagtcattcgcaccacttgcaaaattatctacaaagaaattttcattcacgcgacctttatatgtcgccacagtcgcttcataagcagctgcataagatttttgatcgattttatctttatctaaatcaatcacttttttatcgttccccataaatggaatatggttagtaaccgatgaccaagaagaacaacctgccaatattaacgtaaaaaataaaacagagatttttttaaacatagtcatacctgattaaagttaataaaacgccgccattatactgtctgaaggggattaagcaaggaagcctgtaaggcttatctaggcaaatgttaatttcgtataaaatcagtaaaatcagaccattgctcaatacgaaaagcgcgaatatctcgtaccgactgagaaatccacgccaactgttttagtgcattcattgcctgaaagagattcgccatatcttcattcatgttggtatataaacttccttgtgttctaacaaaaccaaattttgctaaaactgcgccaatgtctgtataagcctcttgaacgccctttggatgataatcttgagtgtcttttacaactaaatcaaaagcaatcgcgtacataattttccttattcagcttcgggatcttcaagtaggtaagataagcgataaatgtctttttctccagattgtaacaatgtgatatttaccaacacatcaccatctggcaaaaattccgcaacctcgccaaccacataaggcacgccaaattgcccgaattgcttaatacagcctgttggaatttgttgtcttagttccatatttaacctcaaattttttatggttttataacataattttgtagagaaatggataaaaatttaccgcacttctactcctgctcttttactaaagacaccaaaatctgatcgattttaaagttttccgtatcaatcacttcaaacttgtattttccgtaaaccacagaatcggtttttttcgggattttacgtaacatatacatcataaaaccactgatagtttcgtagttttcttcatcgggaaaataagcaatatctaatactcgagttacctcttttaatggcgttgcgccatcaatcagccacgagttttcatcacggctcacaatatattcttcttcgttagaaaccaattcccccataacaatactcatcacatcatttagcgtaacaatacccaccacaagagcatattcattcacaataatcgcaaaatcttcgccagtagatttaaacaattccaacacttcgtaaagagaaagcgtatcaggcacaaataaggctttacggagtagtttaggatctgtgagcaccacattttcattctgcaaatacatagttagcaaagtatgggattcgatataacctaagattttgtcgaggccattgtcacaaatcacaattttagaatgagaatcacgagaaagcgtatccatcacttcttggcgagaaaaagtgcggtctaaatatacgatgttttcacgggttgtcattgtggaagttaccgtacgggcttgcatatcgaaaatattttcgatcaaataatgctcttgagtttttaatacaccagcttctgcgcctgcttcaactacggcgaaaatatcttcagaggtcatgccatcttcacgcacagtagaaatgcgaaataagcggaaaaatacattagcaatagtatcaaaaaaccacacaagcggtttaaacacatacatactaaaattcataatacccacaacgctcaacgccaccatttcaggataagtaatagcaatacgttttggaataagatcagcaaataaaataaacaaacaagtcactaatataaaagcgattgtagaggcggttggctcaatccaacttccttcaaaagaacgatttaaaatatctgcaatgtaaggacttagtgcactttcgccaattcccccacccaaaatcgccaccatattcaacaaaatttgaaccaccgtaataaaacgaccaggatgctcttgtaatttaagcacttgaagcgcacgcacgtcgcctttatttgcaagagattgcaattttaacttacgagaactcgccagagaaatttcagcagaagaaacaactgcactacttaaaattaaagccacaattgccaaaatagtatgaaataattccataatcattactcaaaaatataaaagaaaacgaccgcactttgcgaccgtttgggatattacttatcgctgtcaaaccagccgcgaataaattggatagacaaaaataatgtcgccagcaaaaatacatataaaatccacgaaacaatcggattgcttggtgtatcatcagcagtaatttctttaattgaggttgcattgcgatattcatccatcatcgtaatacgccaaccatagtatttaatttgcacaagtttgttgtcattacccaaagcctgcgcttcagcctgtaaattggccgatccaaatttgaaatagaacgggaaaccccaacgtgtatcttcattgcgatacaccataattttgccatcgtcattttgcgtattgatgtaatatacatcgcgtgttgggccatcagctggattcgattttgtgattgggccatctttatcaacacgtttaacttctacgccagtaacacgcgtcacatcataatgagggaacacataattcaccacagaaaacataaaaccgtggaataaaaaaacaacaataaataagaaatatttaaaaaactttcgcatatttttcccttgtcagaactgtacatttattctacacgaattttaaataaacgctcgaaattttgtgtagtgatttgagcaaacgcctctgcagaaacgccctttaaggttgccacgtattcacatacttctctcgtatacgctggttgattttcttttcctctgtaaggcactggcgcaagataaggcgaatccgtttccaccaataagcgatccattggcacataacgaataacctcacgaatcgcttcggcatttttaaaggttacaatgccagaacaagaaatgtaaaatcctaaatccaacgcttttttcgcaaattccatggtttccgtaaaacaatgaataacgccaccgcacttttcagcatgatgttcgcgtaacattgcaatggtgtcatcgcctgcagaacgtgtatgaataattacaggcttatctaattggtttgcaatatcgatttggctaccaaacaccgcttgttgtgccgctttattgtccgcactgtaataataatctaagccaatttcgccaatcgcaatcacttttggatcttgcgataaacgcaataagcgttctgcgtcataaggttcctcttcaaaatcgaggggatggacaccgcaagcaagcgagacattattaaattcccgtaaagagtcataagcctgctcaaaacggcttaaggttacaccaatcgcgagcaaatgtttcacatcacgcgcacgtgctttttccaccacatccgagatatttttatgtaaattttcataatccaacgcatctaaatggcagtgggagtcaacaatgaacataattatttttccttatgcctaaggcttgaacaccatagacgatatatctttaatttattgcgtttcaaatacttctgtgactaatcgcgtcaagccatctaatagcattaattcaagattcacaccattaattgtaagcaaatctgaccgcactttttgcataattttaatggcttgtaataaaccaagggcagtttgctcatcgctgaattgttcgatgccacggccaagatcagccacttgtcgatgactatcaatttcaagtttatgttttaaacaatcagaaagaaaagccaaaatccaatccacttgctgaacatagcgttctttatcaaacaacggaagcaattccaatggcgaacgtcggcgatagaacacccaaaattgacgtaagaagtttttacgctgttcaatcagcccttgttgtaaagtttctaatgctaaaagcggacgcccaagattcatcgcaagtgcggtcaaaatttcctgattttcagccgcactttctgatttcaaccaatcaacagccatttgttcattaggcacagacagattccacacttggcatcgactgtaaatggttgctaataaacttgctgaactatccgtctgaagtaaaaaataagtatttgaacgaggctcttccaatgttttcaataacgcattggcagcggcttccgttaaacgttccgctccttgcacatacaccactttattaccattttgttgtgcgtgctgcgcaacaatttcattaatgtcgcgtacttgatcgacgccaatatccttaccgtcaatggggcttaattcgtgataatctggatggctatgggcttgcattaaatgacaagaatggcattgaccacaaggtttatcgccttgagctacacacattattttctgtgcaagtgcattaaataaactctctacgcctaaaccagaatcagctttaatcagcacagcatgatgccccaacccttcgtcaaaggtttgagcaatttgatgataaattggcattagccaagggtaaagtgcggtcatttttcctgaaatttttgtaaataacgagggcaattatacacattttcaaactggcttgacaaaatagcaaaaagcaaacgtttacttttaataaataagaaataaatagaaaaaatttgaaccaaatggtatttttttgttcagttttatactagaattcacgccccatttatttttacttgacaaaggaaaatttattatgaaactcgaagcaagcaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttttaagtttagtagtaacaaaaaatcggcaggaaaattttctgccgatttttttattctgaaagtgcggtcatttttcgtttgatttccaccaattttttaccgaattttcaattccagccaatgtagggtgggcgtaagcccacgggtattattaataccattctttttttcgtgggcttacgcccaccctacgagcttaaccttataagcgacattcaatcgccaaacaggcaaacatcgccacgctaaacaaggcgcgctgaatttacagtggacgttttaagttaagttgtaacaaaataaaatcggcaggaaattctctgccgattttttattttaaaagtgcggtcatttttcgtttgatttccaccaattttttaccgaattttcaattccagccaatgtagggtttcttctcttttccctccctcccctcccctctctatcttctctccctccctctccttccctccctccccccccctaccttctctccttttcgctcccctttcttcccatatcttttccttctctcatcttcttacccccttcattcctcctctctttctttattgcttccctctctccctcctctctatcttcctcccttccttccctctctttccttccccctctctcccccttccttccctccctctcttctcacttctcttctttccccttttccttttcatattttcctccctcccttttttcccttccctcctttctctttccctcctcctccccccctctttttccttcattccctcttccttcccctctcctctcctctttccctctcccttcttcccccttcctcttttccttttttccctgttcctccactctttccctctttttttttcccctccctcctttctccctctactctttctttcttctccccttcccctccctttccttcttcctctctccttcttctcatgccttcctccatttct

SEQ ID NO: 685 - DNA, 908766 bp, H. influenzae
  misc_feature (9223)..(9223): n is a, c, g, or t
  misc_feature (39640)..(39640): n is a, c, g, or t
  misc_feature (292404)..(292404): n is a, c, g, or t
  misc_feature (292495)..(292495): n is a, c, g, or t
  misc_feature (908604)..(908641): n is a, c, g, or t
acgggtggcgcgtctgcaccgatctattagttcagaaattatttgccgcttaaaagagtttggtgcggatactatagaagagctgcaaggtttagaagaaaatatgttctttgaagtgccaaaagagttgagaataaaagaagttaattaatactaagggcttatcgtcaatgataagtcctttgttttttcattcaaattaagaatttttgagatcgagatcgcaaaagtgcggtcagtttcttgaggttttttgcaaggcaggaaaaaatgtgtgtgttgattgttgatcaacggttcatattataaggaaacctctatgaaattaatgaaaacattattcacttcgtttgtattgtgtgggtcacttgcagctggttccacttttgctgaagacaaggtggttgagcaaacaactcaagctgttgtgaccactcaaacggattcacaagtagcaccagctatgatgggagataaattgaatattaacatagcaactgccagtgaaatacaaaaatccctaactggcattggtgcgaaaaaagcggaagctattgtgcaatatcgtgaaaaacacggtaattttactaatgtagaacagcttttagaagtacaaggaattggcaaagcaacactagagaaaaatcgggatcgtataatcttttaattttctaacctccaatgaatgccctgtttcacagggcttttttattctttacacacagaatacattaaaaagccgttggcaacttgagtaaattttaatacagtagcaagcctagtcggggtgcaattcgctgagatcatacccgtgaacctgaaacagttaatactgacgtaggaaactaggaatataaccttatctccttttcgtcattattgctgccttttaatcataaataaggatgtaataatgaaacttcttaaattaaccttaatttctaccgcacttttttccactgctgcattagcacaatcacagcaaagtgtgaacgtatatagctacgattctttcacttctgaatggggtgctgggccaaaagtaaaacaagattttgaaaaagcacacccacaatgcactattaattttacgccttttgaaagcgttggagtgttgctcaaccgtgttcgcttggaaggaaagaaaacaaaagcggatattgtgctaggtttagataacttttttttggaacaagctgaaaaaacaggtatttttgcaccaaataacgtggatttaactcagcttgatttaccaacaaaatggacaaataagaccttcttacctttcgatttcggtaattatgcttttgtgtacgataaaaccaaattacaaaatccgccgaaaagtttgaaagaattagttgaacgccaagatcttcgtgtgatttatcaagatcctcgcaccagcagtgtgggacgtggtttattggtttggatgaatgtaatttatcctgaagataaaattcaatctgcttggaaaaatttagataagcatacggtaacagtgggtaaaggctggtcagatacttacggtgcattcttaaaaggcgaagcggatttagtattaagttacagcacatcgccactttatcatcaactttttgagaaaaaagataattatgcggcgacagattttgcggaagggcatattactcaagtggaattagcggcgcgagttgccaaccatccaaatcaatgtgcggatgattttatggcatttttaatttcgcctacagcacaaaaacatattgtgacagccaatattatgttgccagttattcaaggcgaaattgaaccgcactttgatgcgctgaaagttcaacaaaaaactcaaacgccaattaatccaacagtgaatgctgagcagttaaaaaattggatcagcacttggcaaactacattaacaaaataatttgatgttgtcgttatttcatcatccacaacttcgccctcgtcattatgcgggcggggttgttgtcattagtttcattattcttttttatggtagtgccttaagttcgatctttacattgggcgatgaattgcaatggcgagcttggtttactgatgattacctacagcatctgattcttttcagttttgggcaagctttactttctaccgttttatctattttctttggtttacttctcgctcgggcattattttataagccattttttggaaaaaagtggttgttaaaattaatgtcgctaacttttgtcttacctgctttagtggcaatttttggtttgatcggtatttatggttcaagcggttggttagcttggtttgctaatctttttggaatgtcgtggcaggggcatatttacggactgtcgggtattttaattgcccatctttttttcaatatcccactggcagcacagcttttcttacaaagtttgcaaagtatcccttatcagcaacgtcagcttgcagcacagctcaatttgcaaggttggcaattcgttaaattggtggaatggcctgtttttcgtcagcaatgtttgcccacatttagcttgatttttatgctgtgctttaccagttttaccgttgttcttacgttaggtggtgggcctcaatatacaacattagaaacagcaatttaccaagcgattttatttgaatttgatctgccgaaagcggcactctttgctatgttgcaatttgtattttgcttgcttttatttagtttaacatctcgtttttcgccttctaatcaaaatggcttgagcaatagtaatatttggtttgtgaaacctaaaagtgcggtcaaaattttctatgtttttgttttaattgtttttgtctttttccttttttcgccagttttgaatattcttattagcgcattgagttcatcaagtttactcaaggtttggcataattctcaactttggcgtgcgttaggttattcactttctatcgcacccttgtccgcattacttgcattaacgatggcgattgccttattgcttttatcacgccgtttagaatggttacattatcagaaaatcgctcaatttattattaatgcaggaatggtaattttggcaatcccgattttagtactcgcaatggggttatttttattattacaagagcgtgatttttcgaatattgatttgtttattatcgttgtattttgcaatgcgttaagtgcaatgccttttgttttacgtattttgagcgcaccttttcataataatatgcgttattacgaaaatctgtgtaacagtttgggaattgtgggttggcaacgtttttatctgattgagtggaaaaccttgcgcgcaccgttgcgttatgcttttgctttaggtttggcgttatctctcggcgattttacggctattgcgttatttggcaatcaagagtttacttctttaccgcatttgttatatcagcagttaggtaattatcgtaatcaagatgccgctgtaaccgcagggattttattattgctttgtggcatattgtttgcctttattcacacatatagggatgctgatgatttatctaaataatgtgattttgaatgataaaaccttaccaatgtgctttaatttgaacgttaaggctggcgaacgtgtcgcaattattggcgaaagtggggcggggaaaagtaccttattgaatttaattgctgggtttgaatttcctgctcaaggagaaatttggttaaacgataaaaatcatacgcgtagtgcgccttacgagcgtcctgtttccatgctatttcaagaaaataacttatttccccatttgactgtacaacaaaatcttgccttaggaataaaaccctctttaaaattaaccgcacttgagcaggaaaaaattgaacaggccgcttgctccgtaggattgggcgattatttagagcgtttaccgaattctctttcgggggggcaaaaacaacgagtggcattggcgcgttgtttgttgcgagataagccaattttgttattagatgagcctttttctgcattagatcagaaacttcgggtagaaatgctggctttaatcgctaaactttgtgacgagaaagatttaacattgctacttgttacccaccaaccatcggaattaatcggttcgatagatcaagtgttagtggtggaaaatggtcagataagtcaattgcaaaaaggggtgtaaaattagtttcattcataacgttgaattgattgtttctaccatatacactaattcatcaattaagaaagtataaaaagcgtggtgtttttaaccgcactttcaaaggaaaaacatgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcgggacgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaacattatgcagaagtgattggtactcgccgttttgatgatcgtcttagtaccttaggaaaagtgcgcaaagctggattaaaagtgtgttgtggtggcattgtggggatgaatgaaacccgtaaagaacgggctggattaatcgcgagccttgcaaatcttgatccgcaacctgagtcagtgccgattaatcaactcgttaaggttgaaggtacaccgttagccgatgcggaagaattagattggacggagtttgtgcgaacgattgctgttgcacgtattactatgccaaaaagttatgttcgcctttctgcaggtcgtagtggtatgactgaagaaatgcaagcgatgtgttttatggcgggggcaaattcgattttctatggcgataaattacttgttacagataatccagaagaagatggcgatcagttattgatggcaaaattagatttagagccagaaactgcagaaaataaaaagttgtagtttgcgttagaaagctgagaaattaagtataaatctattcctttctttatttcatatctcacaataattttcaatagccaataaaaaagctccttgaatatcaaggagctagtttagtttaatcttaaagaatttctttcgcttttgctaccacgttttcaacagtgaaaccaaagagtttaaataattgatctgctggtgcggattcgccaaagctattcataccgacaacacgaccattgaatccaacgtatttataccagaagtcagcaatacccgcttcaatcgcaacacgtttggttaccgctgcaggtaatacactttcacggtatgcttcgtcttgtttatcgaaacggttagtacttggcatagaaacaacgcgtacttttttaccttcagcacttaatgcttcggctgcttgcactgctaattccacttcagaacctgtcgcaatgaaaattaactcaggtgtgccatcacagtcttttaatacataagcaccacgtttaaccgcatctaattgtgcagaagtgcggttcatttgagcaagattttgacgagtgaaaattaacgcacttgggccatcttgacgttcaaccgcttgttgccatgcgatggctgattcaacttggtcacatggacgccatgtttcaaggtttggaattaagcgtagtgaagccgtttgttctactggttggtgtgtaggtccatcttcgcctaaaccgatggaatcgtgggtataaacgaataatgtgcgttgtttcattaatgctgccatacgtactgcgttgtgagcatactcgtagaacattaagaaggttgcgccgtaaggaatgaaaccgccgtgtaaggcaatgccgttcataatggcagacataccaaattcacgaacaccgtagttaatgtagttaccacttacgttttcgtgggcacgaatcggttttgaaccactccataaggttaagttggagcttgctaagtctgcagaaccacctaaaaattctggcaataggtgtgcataggcttcaatggcattttgtgatgctttacggcttgcaatactcgctggatttgcttgtaatttttcgatgaacgctttagattctgccgcccagtttgttggtaattcgccagaaacacgacgtttaaattctgctgccaattcaggataggcttttgcataagcggcaaatttttcttcccaagatttttctgctgcagcacctttctcttttgccgaccattcagcatagtattcagctggaatttcaaatggcgcatattcccaaccaagtgctttgcgggttaaagcgatttcttcatcgcctaatggcgcaccgtggcaatcatgagaacctgatttatttggagaaccaaaaccaatgatggttttacaaataattaacgttggtttttctttttctgcttgagcaagaacggcagcagcgcgaatttgctctgcattgtgaccatttacattacggattacttgccagccataagcttcaaaacgctcggcggtgtcatcactgaaccagccatcaacatgaccatcaatggaaatattgttgtcatcgtagaatgcgattagtttacccagacctaatgttcctgctaaagagcaagcctcgtgagaaatcccttccattaaacagccatcgcctaagaacacataagtgtggtgatcgacaatttcatggccttcacggttaaattgtccagctaaggttttctcagcaattgccatacccaccgcattagtgataccttgacctaacgggccagtcgtggtttcaacaccaggtgcataaccatattctgggtgacctggggttttagaatgtaattgacggaattgttttaaatcttcgatagaaagatcatagccagttaaatgtaaaagactataaatcaacatagaaccgtgtccatttgaaagcacaaaacggtcacgatcagcccatttaggattggttggattgtgttttaaaaagtcgcgccataatacttcagcaatatccgccatccccattggtgcaccagggtgaccagatttcgctttttgtacagaatccattgctaagacacgaattgcattggctaattgtctacgagttgccattttgttctcctgtgataattcgttttgaaaaataatcttgcgcattctaccttatttctgaaggaaatttagcaaaaatccgcactcaatttaatagtttgtgacaataatcaaattctacgacgacattgatgaaaacgcatactactagattttattgtcaaatttaccgcacttttttctctttgagtttatgataagaacagcgataatgacttaaaaaatacttgttttacaccaaataagataacgccaaatatcgctaggcttagcgaaataatcgttgcaagtatcattgagtagtttttctttaattattttcactttttcaattcacatcggttaaaatctttttagtcgccacaacttacaggatttttatgcaaattcaatgtttcgaaagtattacacaaaaatatccacaatttcctaccgcacttttggctaatgaggagcctatacagaacggagagccttttatcttatacggcacaaagttggacataactaagctagaaaaatttcaacaaaagtgcggtcaaaattttcagatttttgatgtttggatggtagcgaaaaatattatcgtcttattgaaaggtcaatggttttctgatttcattaaatttgctcacgatgttgaagtggatattgctaaattagatttcagccctaaattgtctcaagcagggttgttggtgatggatatggattctaccgctattcaaattgagtgtattgatgaaattgcgaaactagcgggtgttggcgaacttgtttctgcgattacggaaagtgcaatgaggggggaattagatttcgagcaaagtttgcgttgtcgagtgggtacattaaaaggtgcgccagaaagcattttgcagcaagttagagagaatttaccgctaatgtctggattagttgaaacgatccaaaccttacaaaaatatggctggaaaactgcaattgcttcaggcggatttacttattttgcggattatttgaaagccttattgcaacttgattttgctgcatcaaatcaatttgatattgaagatggaaaactcacaggcttagttaaaggcgatgtggttgatgcccaatataaagctaaaacattgcaacatttgttagaggaatacggtatttattcccaacattctattgctatcggcgacggtgcaaatgacttggcaatgatgaatgtggcgggactaggtgttgcgttccatgctaaacctaaagtgcaacaacaagcgcaaattgtggtaaacttcgccgacttaaccgcacttttatgccttctaagtgccaatgatcgaatttaataaaatgggagaagactatgccatcttttgatattgtttctgaaattactttacacgaagttcgtaatgcagtggaaaatgcaaaccgtgtgcttagcacgcgttatgattttcgtggtgtcgaagcggtaattgaattaaatgaaaaaaatgaaacgattaaaatcaccacagaatctgatttccaacttgaacaattaattgagattttaattggatcttgcattaaacgtggtattgagcacagttctttagatattccagcagaaagcgaacaccacggtaaactttacagtaaagaaatcaagcttaaacagggtattgaaacagagatggcgaagaaaattactaaattagtaaaagattctaaatcaaagttcaaactcaaattcagggcgaacaagtgcgtgtgacaggtaagtcacgcgatgacttacaagcagtgatttcaacttgtaaaaagtgctgaattaggtcagccattccaatttaataatntagagattagtttttcaaataagggcgaaatgttgccatagttttttgataaaacttgacgaacaccgctttcaagcgtaacattcgcccgattttttaacgagaaggacacacactttggacagtcatagtcgataccgaatatcgctctagacgctcgccttttattatcggcgtgcgttcgccggtaaatttaccgttgtttcggcatctcttaacgaaaactttgcgattttttaccgcactttcgtttcttctttaatttgttcactgttagctgttcataatcctataaggagtatgaaatgatcaatgcgtttgctatcaatgattcccgcttggttcgtattgacgaagaccaaactgatctcaatactgccatttggcttgatttacttgagccgacaggcgaagaacgtgaaatactacaagaaggcttaggtcagagcctagcatcttttctagaactggaagatatcgaagcttccgcccgtttctttgaagatgaagatggtttacaccttcactcatttttttattgcgaagatgaagacaattatgctgatttagcgagcgttgcttttactattcgtgatggtcgtttatttacgttgcgtgatcgcgagctacccgcattccgtttataccgtatgcgttcacgtagccagcgtttgttagaatgcaattcctatgaagttttactggatttatttgaaacgaaaattgagcaattagcggacgtgattgaaaatatttatgcagatttggaagagttaagtcgcgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcacgagaaatcttacgagatattgaatctttgcaaccgcataatgaatcattattccaaaaagtaaactttttaatgcaagctgcaatgggttacatcaatattgaacagaacaaaattatgaaattcttctcggttgtttctgtgatgttccttcctgcaacattagtcgcgtctacttatggtatgaactttgattttatgcctgagttacattttaaatatggctatccaatggcaattggattaatgatcgcagccgcactgacaccatatatttattttagaagaaaaggatggttatgatggaattatcccaaaccgcattatttatcggatcaattattaatctttacgcacttgtagtaatcttacgagcttggttgcagtttgctcgtgtggattattacagtcctgtttcaacatttgcagtcaaaatgactgatccaatattaaaacctctgcgtaaaattgcgcctactgtgaaaaatatcgatacttccgcattactgcttgtatttattattggtatgttaaaaggtattatttattttggcttatcagtaaatgtactcttagtattgggcgtattaactgtattgaaaagcattggtttagctattttctatgtgctttttattggggctgttttaagttggtttaatcgaggtaataattctataagttatgccttttatcaactctccgaaccacttttaaaacctatccgtcgattcttacctacattaggcatgattgatttttctccgatggtcgttgtatttatcttattatttttaaataattttatgcttgatcttctaggtggactttggattatcgctggttagatattcatattccttatttgaatattgctttataaaaatattgaagatttagttggtaagaatagtattttctattcttacctttttatttcgtttttagaggtttttgatttttataattcttataaaagatatgaaattcttttataaaaataaggggagtttatttacattgatatttaaatagcagaatttattgtcctattacctaaagtaccatcatcaatcgcttcttttggcgtcccaataacttcggcgattttctctccatttttaaaaaacacaaatccaccattttccatttttgtccaagattcatctttggttaaaggaaatgttgtgatgatattgaccttatctcctgcttttgcataattgctaaaatcaattactccatcatcatcaatacggtgagctttgccaaaaggtgcttttcgcataacataatgtaagtttgttgagcaatgtgcaatcatccactcgccattagaaagaatgaaattaaacgtaccgtgttgagcaagttcttgtgttactttttgaattgcttcaaaaatttccatttcacttggttttttgcggaaagtatttttaagatactcagccatataacagaaagcagcttcagaatctgtagaacctattggctgtaaaaaatgatctgtcatatctggtaagttttttaaattaccattatgtgcaaaaacccagttttgtccccaaatttcacgaatgaacggatgggtgttttcaatattgacttcgccttgtgttgctttacgaatatgcgcaatgacattaagagatttaatattatattgttttacacaatctgcgatgggggaaagactggctgtttgattatcacgaaaaatacgtacacctcgtccttcaaaaaaagcgaccccaaagccatctgaatggcaatctgttaaacctgcgcgacgacggaaaccttcaaaagaaaaaacaatatccgtcggcgtattacaattcattccgagtaattgacacataattttaattagatataacctcacaatatgtgagtgatttaacaccattatagggagaatatcaagagagatttaatgaatttttatgttgtatagatattaatgatagaaatggtatttaatctattattttttattaatattctttatttttaaagaatggtaaaaaccactgatatttgaaaagtcattgcttagatagaattaacctcctttgcaatttaaccaagttacttgcttgccttgttgattcttgtagtaaattgaactttgagatcgcacgattaaatctacataacttccttgaattggatcatacgaacgataaatcgcttcaaattttgtaccacgggtattgagtgttagcgtatataaatgatcaaaaggtatcgctttgccattatctaactgaaaataaaaactaaaattttctttcatacggctttcacgcgacagagggaaataagtcgtcaaatgagaaattcccccagtttctttattattacaacgataatgatatggcttgtaattaacagaattatttaactcagtttggctaatattattctttaaaaatcgagatttaaccgttttcttcggctgatgtattgtggtacaagcaaataaactcacaagagccccaacaaacaatgccatctttaatttattcataaatacaaaattcggagaaataagaggcgcgtatgatagcggaaattggggactgtgcaagggattggaatgagactaaaaaatgcaataaaaactggaaatgtaattccaaatacatacaaaaaaataaaatatggaaattaacttccaaaccttgtacactttttacaaatatgaaattaacttccaatgagtaaaactatgatctctcgtgaaaattatttacagcaactgattcaatttaaagatactgattttatcaaagtcatctcgggtgttcgtcgttccggtaaatcggtgctactcatgcaataccgtgattaccttcaacaacaaggcattgcttccgaaaatattctttatctcaattttgaatcttttgaatatcaatgggtgaaagacgctcaagattttcaacagctgattcaagaaaaaatgccgtcttctcaaaagaaaatctactttctgattgatgaaattcagtttgtggaaggttggcaaaaaatcgtcaatgggcttcgcgtgagttttaacgctgacattgtgattacaggttccaatgctaacttgctttccggcgagcttgcgacgttgttaagcggtcggtatgtagaaatcaaaatttatccgctttctttcaaagaatttttgcacgccaaaaatgtggatagccaatcaagattggtcgataaactctattcggaatatgaaaaatatggcggtttccccagcgttgtgatggctgatgagcctttaaaagaaacgattttatcgggtatttttgattccatcgtgctaaatgatattgcccaccgagctggagtgaaagacacgcatattcttaaaagtgtaattctctttttagcggataacgtagggcagttggtgaatccaagcaaaattagcaacacgctcacgtccgaacgtgttcccacttcaaatcacaccataagcaaatatcttgatttgttagaaaatgcctttcttttttataaagcaaaacaatacgatattcgcggaaaaggctatttaaaaaccaatgccaaatattttattgtggataacggtttaagacgacacgctatcggcaaaaaaggtgcgaattatgccaatcgcctagaaaatattgtctttattgaattgcttagacgaggttataccgttgatgtgggtaaactcgacagcaaagaaattgattttatcgcccgaaaagctgatgaaattttatatgtacaagtcgcttttgaaatccctgaaaatacccacgaaacagataatcttttgcatattaaagataactataaaaagattttaattacggggaaatattacgaacaaacagagattgatgggattgaagtgatttatgtggtggattggttgttgcaataagtctaaaaacgttgaaaattttcaccgcacttttgtgtttaacgcttatgccgacgcgcgtttcccaacgcgtgccctagaaattaaagtgcggtgagtttttgaggtgtttttattgaagttaggcacacgctgggaagagtgcgccatcgtgggggcagtactgtagagtttgttagtaaacaacatctacttattatttaataattggtcatatgctgggcgaactccacttggaatacttccagaatcaattaattttaaagcttctataaatcttattcttccatattcatcgttggtttttcttccaattttagaactattaatttttgcatgggtaatcattaggttaatttcttttggagaaaagtttctaataattttttcataaaatggaattgctccccatgaaactccatatttgtttcccaaataacaagaaactatcgtatctacaaaatcactttgggctgtttcagggactgctgtattttgagacaattctgctaatctttcagcatagggaggctcattataaaaattgtttagcccatcatgagcgatttgcaacctgttaattgctgctgaaaaaatcgcatgttgttgtggagctgatagcaaccctaataaacttaatttctcaaaaaattgactagatgctcttaatctttgttcatctccttttgcgatatattcagagtgtttatcaattaatgaagattttagtgaagcagaaaaactattttgaaagaaagcacaaatatctaaagcatttaatctagttgtttcctgtgagtttgggtcacaataaataccgtgtgccataataatcaataattgtttctgtgcttcgtgagttttagatagcctatcaatccaatattccctttgttcttgattaaatcttccacctttaatcgattgaataaaatcactaatattgactcctttaggtgaagaagaatcacctaaagcatattttatacaacgatttaagaatgtaatgaattctctatcattcaaattgccaagtgaagggtgagcagcagaaaaattattacggatatttctacattggcctagaaaaagaaagccttcttcgttaagaatgtttaattgcaaacataaatctagtaactgactatcctgtaatgctattaaatggccttcttcaaaatccctttccaatacttgagcaacaattggaagaccaaaggttctaactttatcacgcaatctcaaaatagaagcattccatatatagttgattgcaccatcaaataatcctgagctaattgcaatgcacatacgagcaataagctcaggattcacattctggactggtatatttcttaattctctaggtaaatcattccaagcatatctaatttcttcatcacttgctaaaacgtctcttggaatgcgaagagcagaaactagttgattaattgcgggaatagtattaactgataaatcgggtaactgactattaaaagttgttagcgaattatttaaggacataaaattttctcccataataaattaagttaataaatagtttaagtttttattcctaggctctaattgtatagttttaataaataacttcaaatataagataacgttatatcataatatgttttatccctacttcatcgcccccccccaaccacttcaacatctctctctcatcccaacctttacgtttggcataatcttgagcttggtcttcatcaatgcgacctgtgattgatgccgaaaatggctaaattcattgacatcaagcacatcataactacgaaaggtatccgtgtacacaatgctatcaggcttaacttttcctcggataattgacaataatgtcgctgattgcgcattagggacaacgacggtataaaccttgccatttcgtttgagaagccagaataccgcgactttttctcattggtttattctaacctaaatgggatttttagtcgttatctagtacagcctcaagatttttatttaagtgtaatggctgcgacaaaacaggtaattttacattctccgcacccattgcaacgttcattatcaatctctaaagtgctggagattgcttgttgtgtgcaagcggtttggcagtctggacaggtttgattttgtaggattaaacaggctgaggaaaattgtggacgaagtaatgtatccgctggaaaattaggatgtagtgcatttgtcggacaaacttctgcgcatttaccacacaaatcacaaggtgcgtagtcaatttcaagggtggcttgttgctgttttagttgaattaaaccattagggcaagctgaagcacattccccacaaccattgcagacggcggaaaataaatcttctcgtgctgaaaagggaggacgagattgcgttttttctattgttgattttgtagctggaaatatatgacgcaatagtcctctacgagaaatgtgatggtggcttaaataagcctgataataggcttcgtttttcattatcgataaaatcttactgtcggtatattaatatgtaaatctacttgccattgttgtaaagtttttagggtaagtaatgcaagagcttgataaaaatcagaattttctattttgcttagttgttcaaggaaatgatacgcccaagttaagaagtgttcacgtagaaattcgattaataagtgcggtcgattttctgctaaatatgcagcaagcattaacattaagccaatatgatcttctggttcatcttgttgtgtttgaaatgcgatttgatgttgttgtaagaaatcgcgtaatgctaagagagaattaccaaaaataacacattcaggatcaagatatacggatccccaaggtggcgtaggtaattcatttggaccaataaataaatactgatattgttcattgatattttgttgcagccctttttcaataagtgcggtaatttttttatgtgtttttacatcaaatgaaatttcccattcttgcatccaatttggttggcgaaagaatgtcaaaatatcagtaagtcgtgcatcattaggctcatagtaaaatactgcaccgagtaaacgcccataaatagaaatttgttgaagagtattttgcatagtatctccgaaaacaatttgtcattagtgaatggggatatgagggttggttaaatattactaattaacgtttctaaaaattgaggcgtatgctatacgcctcaacataatttaaccaccaatcgccatgccgtaagtcatatgtaatccataaaataatacgcgaccgatgccttcagctactaacgttaatagaacggaaatacctaatagtcctatgtttttcactcggaataagaggaaagctacaatggaaagtaaacataagcgagttacggtcattatggcataatttggtacgaggtcagcggcattttgaatagcactgtgaatattgtgtaaattgaagccttgatatatggctactattgcgaccaataatactccaatggcaaataaacttggcagatgctgaagctgatattcacgttgtttattagggattaataacgcatagcttaatgttaatccacctaatacaacggtaagatagaatgaccaagaggttaatgcattattccaagttggtatgcttgtaatatggtaaacctgattcattacatacataaatagtatgccgataagggcggtcacaattcgccatacatttccaagtgaagctggcattttacctaaaattgcaatcagccagtagaaacctgctaatgcgaaaaatattgcaccagtggcaatttcattactcatcattgatgagccgactctattaagtgaattaaatgcacgtataggtaagccaagatgcataatggaagcaataaatccaatacctagcaaagccaaaatcacaaacattactttatgaatataagtgcgactttttgtatttttctcatttaatagtacaaatgtgaaaacaagccaagcaccgaccgcactttgtgccaaaactgtaaaaaatactagtggcagttcatataatcctgtattcatcttacacctctcttgggtttcctaagaacccacttgtatcgccacttaaacgagcgtgtttattgggttttacaactaaatttggttgagtgatatcagccggtggtagtggtgcgatggaggcttgagtgccgtattttgctcgaagttcatcaataggagcgaaatccaatgctcgtagtgggcaggcatcagcacaaatcggtttttgacctgattttacgcgagaataacatccatcacattttgtcatatgacctttttgtgcatcatattgcggtgcatcataaggacatgccatatggcaataacgacaaccgatacaaatttcttcattgacgatcacgaaaccatctgcatttttgtgcattgcaccagttgggcaaacttttgtacaagcaggatctgcacaatgattacaagaaatagacatataataagcaaatatattttgatgccagcatccatctgcttgttgattccactgaccacctgtatattcataaatacgacgaaaattgacttctgtgccaagatctttgtaatccttacaggctaattcacaagttttacagcctgtgcagcgttcagaatcaaaataaaaaccatattgttccataattatccccctacaaacgttccacttgaactaaattagaatgttgcggattacctttcgcaagcggtgatgggcgttgtgtcgtaagtacattaatgcaacctgaatgatcgatacgatctttatctggtgcataccaagccccctcgcttaatgccacaacccctggaataatacggggggtaatttttacattaatacgtacttcgcctcgatcattaaagatacgaatcatatcgccatttttaatattacgaggttctgcatcaataggattcatccaaacttcttgtggattagctgcttttaatacatccacattgccataagttgaatgggttcttgctttgtagtgaaaaccacttagttgtagcggatatttttccattaatggatcgccgtaatgctcaaaactttgggcgtgaattggtaaaggatgaattatttcatcttctgctaatttccaagtgtttgctatttcagctagacgagaagaataaatttcaattttgccagatggcgttttaagtggatgggcttctggattatcacggaaatctttgtatgcaactttaaagccattaggatcaacctttttaaaaataccttgttgtctaaattcttcaaaagtaggtaattcaggtaatttttctcgagattgctcataaatatggcgtaaccattcctcttgtgttcttccttcagtaaatttttcttttacgcccattttctcagctaaatcactcaacatatcgtaaataggtctacattcaaaagatggtttgatcacttgatctgcaaaaatgacataggccatattggatacaaaggcatctaaagcgaaatccatttgttctgaagttgtacaatctggtaataaaatatcactgtatttggcagtagatgtcatatgattatcaatagtaatgatcatttcacattgggtatcatcttgtaaaatatcgtgagtacgattgatttgtgcgtgttgattaatcaaacagttacttgcgtaattccaaattactttaattggggacgataatttatcaacaccacgaataccatctgtaagtgcggtcatttctgtgccacgaataattgcatctgtccataaaaacattggaatgcttgctttcacaggattttttagcgttggcatccgcacaaatggaatgctatacgcactttcacgtgcaccagtgttaccgccgtgaattccaacattacctgttaagattggcaacatcgcaatggcacgagagattaattctccattactacgacgttgaggcccccaaccttgggaaataaaggcaggttttgtgctgccaatttcacgtgcgagtttaataattctctccgccggaatacccgtgattttagccgcccattctggggttttagcgataccatcattaccataacctaaaatataggctttataatgaccatttttaggggcatccgcaggtaatgttttttcatcataaccaacacaatatttatctaagaaaggttgatccacgagattttcttgaatcattacataagcaagggcagaaacgagggctgcatcagtgcctggacgaattgggatccactcatcttcacgccctgcaccagtatcattataacgaggatcgataataatcattttggcattggaacgagctttggcttgttcaatacaataagttaaaccacctccactcatacgagtttctgcaggattattaccgaataacactattaatttggtgttttcaatgtcagccattccatttcccaatgcccaaccaccaccataggtataatctaaaccgactgcaatttgtgcggtgctgtaatcaccataatggtttaaatatccaccaatacaattcataaaacgagcgatcatagtggatgcaggaggccaagatttagccattgtgccaccgagtgttcccgtaccatagtttaaataaattgattcattgccatattttttgatattgcgtttcaatgcgtctgcaatttcagttaaagcctcatcccaactgattcgtttgaatttaccttctccgcgtttacctatacgtttcattggatattttaaacggtctgggttatacactcgacgacgcatagaacgtccacgtagacaagcacgaacctgatgatcaagattatatgtttctgtccccgtattatcggtttccacataagtgattcggttatcttttacgtgcattcgtaatggacaacggctaccacagtttactgtacaagcactccaaacaatacgttcctgactattttcattgaggtgttgtgtctctttagccattacattgaaaggtaaagtaagatttgaaactgccagtgcagctcccgcagatgacgccttgacaaaatctcggcgacttatttgattaaagttactcataatatcgtcccccacagtaagatcgagtaataactaaaacgagttaattataatctttgtatagaagttttacttgagccaaatcaactaattattaataggtacattatttatagggtattttagtaggttgatgtttttataaattttggaataacaaattgactatagatttaaaaatccgttagcatagtggcgtattagtttatctaatatgttaagtttaactattattaactagaggatcttttcatgaagaaacttatcgcggttgcggtgttttctgcgtgtggctcgttagctcatgcaaacaccattattccaaactacaatacagacgcccatctttacgaattcacgcaaacctatgatttagttgtgccaaaaggctcgcaaggacaaaccaatttatgggttccattaccatttaatggggaataccaacaagtgaaatcgattcactttgaaggtaattacatgaatgcctatgtaacagaaaacaataaatacggagcgaaaaccttatttgccacttgggataaagatgcacaaaaacgtgatttaaaagtcacgatggtcattgaaacaaaagaccgtgaaccgatggtgaaaggtgctttagagaattatactccgccaaaagatattcagtattccgtggatgtacaagaatacttaaaagctactccacatattaaaactgatggcattgtgaaagaatttgctgacaaaatcctaggtaaagaaactaatccattgaagaaagcagaacttattcaccactggatcgtaaaaaatatggaacgtgataattctgtattaggttgtggtgacggcgatgtagaaaaaattcttaccactggcgtgttaaaaggtaaatgtaccgatattaactctgtatttgtggcacttgctcgtgctgcaggcatccctgctcgtgaaatttttggtattcgcttaggtacggcagagaaaatgggcaaatattcaaaaggtgccttcggtagtgcaaatgaacaaggcatcgtaaacgtaagtggcggtcagcactgccgcgctgaattctaccttgcaggatttggatgggtaccagttgattccgcagacgttgccaaaatgcgtttagcagagaaaaaatctgttgaagataaagatacacaagccgtagcaaaatatttgtttggtaactgggaagcaaactgggtgggatttaatcatgcccgtgacttcgatttatatccacaaccagaactggctccaatcaataacttcggctatccatatgcagaagtaggtggcgatccgttaaattcctttgacccaaaagaatttaaatatgactacgtatctaaaaaactctaataaatccttttgggttgccatagccgccgcactaagtgctgcggtggcatcaaccttgtgctgcatcgcaccattaatttatttagtatttggtgtgtcgtccacttggttgattggcttaggcgaatatgattatttgcgtattcctatgcttatcatttcattatgtgcctttgcctatggattttggctgttgatgttttccaaaaaaatcatttgtagcaaatatatttcccgtaaaaaacttatcgttttatattggattgtatttatcgtgatgatttttttcttaacctatccaacaattttaccttggattttagaattagctaattaggaataaaaatgaagaaattatgtaccgcacttttgctttcgctgtttgcaatttctttcgctcatgcgaatgaaaccaaacaaattgtgctaaaagtaaaggaaatgaattgccagctttgtgcttacttagtcaataaagaactgcgtaatattgatggcgttatttcaacaaaagcatctattaaagatggtttagtgacggttgtggaagatccaaaagtcacaaaccaacaattattcgatgcaattcacaagctgaaatatactgctgaagtcgtgaattaaacgctaaatatctagcaaaaaagtgcggtgaaaattcaccgcacttttctttagctattaaattagactaattttttaattagcttgattacagtacaattaattaaatatgataaacgcaatattattcagcacttccgcttaaaaatccgccactttgatgattccaaagtttagcgtacagaccattgagctctagtaattcggcgtgcgtaccttgttcgacaatttgtcctttatcaagcacaatcaggcgatccatcgctgcgatggtggataaacgatgggcaatggcaatcacagttttattttccatcatcttatctagactttcttgtattgccacttccacttctgaatccaatgcacttgtggcttcatctaacaatagaattggtgcgtcttttaacattacacgagcaatggcaattctctgacgctgaccaccagaaagttttaccccgcgttctcccacatgggcatcatagccttttctaccttgagaatcactgagaaatgggatgaaatcagcggcttccgctcgttcagcagctaaaaccatttcttcatcagtagcattcgggcgaccataaataatattgtcacgtacagagcgatgtagcaacgaagtgtcttgagtgactaaaccgatttggcgacgtaagctttcttgttgcacattgagtacattttgtccatcaatggtaatttcgccttgttgtgcttcataaaagcgaagtaataagttcacaatcgtagattttcctgcaccagaacgaccgattaacccaaccttttcccctggtttgatagtgagattgaaatgattgagtaatggttttgtcggatcgtaagcaaaggtaatatcgttaaacttaatttccccttgtttcacttgtaacggtgacgcttgtggtttgtccacaatggtgtggggtttagttaaagtattcattccgtcgtttacggttccgatattctcaaacaaacgggcagattcccacataatccagcgagaaagcccatttacgcgtaatgccatggccgttgccgttgctattgcacccacgccaacttgaccatttttccataaaataataccaagtattgcagtacttaacgtaagtagaatatttgtagcgtaagtgagtgtatctagtgatgttgctaagcgcatttgggcgtgtactgttaccataaaatcttgcatagaacgcttggcataagtagcttcgcgtgagccgtgagaaaataattttactgtagcaatattagaataagcatctgtaatgcgtcctgtcattaaagaacgagcatcagcttgtcgttgtgcggtttttgatagtttaggaattagggttcgtaggatcaaaccgaagagtataatccaagtaataaatggtaataagaaccaagaatctaatgccactagcactacgccagaggtaataaaatataccaatacataaacgaacatatctgcaagtgtaagtactgtgtcacgtactgcaagggcggtttgcattacttttgcggatactctacctgcaaattcgtcttgataaaaacttaaactttgtccaagcattaaacgatggaaattccaacgtaatcgcattggaaatacgccttgtaaggtttgtaaatgcacggccgaagctaaaaatccccacacaatactaataagtaatagagcagccattccaattaataaatgacttttttcttgccataatctttcaggtgtaaatgtgcctaaccaatctacaagcgttcccataaattggaataatacagcttccattacacctgtacctacggttaaaattgcgagcaaaaaaatccagcctttcattcctgtaatactagaccaaataaaacggaacaaaccttttttaggtgttgttggattgctttctggatagggattcaaacgattttcaaaccacgaaaaaattttgttaaacatatcttttccttaaaaagaaaaggcaacgcgggttgccttttagaagtgcatattattatagcacaaaaacaaatcaatttataggctgacagattttctgtattggcttggagaaagttggtagtaatttttaaaaactttacaaaaatgcgcttctgattgataccccacttctaaagcaatggcaagcacagattgttgtgattgttttaataaaaacgccgcagattgtaaccgcactttcgtgagaaaacgtcctggcgacataccaagttgttgttgaaaaacacgaataaagtttgcacgagacattgttgcaagttcagctaattgttcaatatgccaatcattttgaggttgttgtaatattgctatcagtgcagtatttaatcgcttatcttgtaaggcgaataagatgccttgttcaattaaattttgttgaatggcgtgacgtaaaatataaattaaaagtacatttgaaagtgcatcaacgaccgatttcgtacccgcatcatttttttgtgcttcttgcaaaaaaagctgcactaaaggatgaatgggcgtgtcgcataaatttatatgtaaatattcaggcattgatgccgtaagaagtgcatcttgttgataataaaaattaccgcagaacatttttaaatctggtgtacctcgtccaatctgatgtaactcaaataatccttgatgacttttttttgtaggaatatctgcccttttatttactgaataatgcataaagtgcggttgattttgaggaagaaaaaaaatatctccctcttttaaatgaaattgtttttcatttagtgtaagctggcactcgccttgttcaataagatggaatatgccttttcctgcatccttttcttgatgagatatttgccattcgccttgaaattcacagcgaatattaatttctccacgcacttgtgctaaatgggtaagtttatctaaatagtccataatgagatgttagcgataaaaattgagataaataagcaagtatcataatctaatccgcctataatttgccacaccagttggttattaattcaatatatttaggagaacattatgtttgcagattggaaagaacacacatctcacgttaaaaaatcatttggcgcattgggtaaacaacaccctaaaatgttacaagcttaccaagcattaggctcagccgcggaagagggcaatgtgcttgacgctaaaactcgcgaacttatcgcattagcagttgctgtaacaactcgttgtgaaagctgcattagcgtacacgcagaagaagcagtaaaagctggtgcaagtgaagctgaggttgctgctgcattagcaacagctatcgcattaaatgcaggtgcagcttatacttattctttacgtgcattagaagcatatagcgtacagaaaggttaattactcgtcattccataaagttaagttgattaagagaaagggagcattttttaatgctcccttgttttgttaaggctgtgttttaataatacaccactctatttttcaagctatgtctctcctaaagggaataactccgtaaattgtccatttttctgatgatcagtaaaaaacggcaaaccgatcaaacgataatgcggtgtatctttttgcaggatcttatccttcccatattccactgtgattgattttaaaaaagcttctttccacctatcagtttccactaaatgttcgcctttgggttcaatgaaaatttggtaatgcaaaaagtcgttcacaccattggaagaagatttttgtttatctttcagcaataaaacaaagtccggcataaatccttcaccatcggcaaagttattcaatttaaacacttcttcattgcggattaaatgaacgtcatatttagatttcaaatcgcccaaacgctctgaaataaattgaattaacgcttcttccaaactcgttccagcaaaattatccatcacataccaatcattttgcatggcaatagcagtttttacatcatcttttttgacccatttttgttttggtgtgccaaaaatttcccacaattttttaggcgtaaattcttttgtaccgataaatggcatatcactttcattgagacgtttttcaaccatttccaagatttttaggcagcctgcaagttgtcatctgggctaatctgtttatcttgccctaatcccaaaaattcaatttgccaatcttttaacaagttattttgcaattcattgcgattttgaatgttgagtttgctttgcaagcgatcgaaatgaaataaagattgactattttttcctttgatatgcaaggctttattaaaaatgtgccgctccatttcactcatttttatggtttgagtaaaattattttgtgtgccgatttgtcgggcggtttcatcattttcatcggctgtaaattgcgtttcctgcaacaattgattgccgtgaatttggaatgaaagcgtttgcggattggcttttaggctgtctgcattattggctttagcattgggattttttactttttgatttgcccaaatcaataggtttttaaaagtttcatcatctgcaaattcagattttagtttgaaggtggttaaaaccttgtctttatcgttttcgggaataaagccatctttgcgaagttctgcttttaattctgaaatatagcgagattgctcatcgtgcgtgtaataaaacaattcttccaaaatacgcaattcgtgttgcatgtcattgtcaaatttgcgtttattcggctgtttatcttcaaacgcaaatggaaaataacgcacgccacgaccaatcaactgcttttccgatacggtggcggcagccgttttgcctgattttttatttgaaccgccgccgttttgcccttcatataaacgcacaatatcaaacaaattcagaacgtcccaaccttcggttaatctgtccaccgtaaaaatggcacggatcggattatcggccgcttccaaattatttagcaatttttcggtttcgctgtcggttttttcggttttggttttgttgctctcggagttggtaataatcacattgtgtttttgataattttgttttacccaatctgccaaatgtgcaaactcaacgcctttttcctgcataaattttagggcttgttcagtgcgggttttgccttgttcgttggcgttatcgctatcgctatcgttcaagcttgttgaaaatgtagttaaaaacgaaaaatcaaccgcctgcacattttctgcccaatttaaaaatgccagataatccgcttttgattcatcaatcgtcttacttctaaacaacatcacaggcttgaaattggcaatgccatatttcaacgcaattcgatgtcgataccaagcaaacaataaagcgtgtaacactcgctctttcttacccagcgtactggataccaaattgatttctttggtataacctttttgcaaaaattcttttaagccaaattttgtgatgattttatcagcgtacttttgttgcacgtcagcattttcaggcagcgtggcggtaaattccaacagcacattttggctatgattgccatttttattgagtaacaattccaaaaccatatgctcccagcctttacgttcaatttcggcattgctggtgcggtcgttcatttccttttctaaatctaattcgccttgttttttgcctttggtttgcgcgtttaaatggtgcgcttcatcacccagcatcacaaggttcaatttgtgcaaatccgccaatgtggtttgattttcccgccgggtgcgaatatcgttatacagcttttgaatgctggtaaatttaatttcaatgccgtctgaatgtgggctaaatgtctccactttgcgaataggaattaccgtatcgccctgcaaaatcttctcggtaaataaaaattttgcgtgcgtcggatcggtaaaattattttccgttttatccacgatattgttttgattcacaaaaaacagaaaatgccgataccctttttcaaaataatacaaaatcaacgctgccatcatcatcgttttgcctgcacctgttgccatattaaatagcaaatgggtagggcggtttttgatatcggggaagtcctttaattttggagtgcggtcaaaaattacaaagttttctaaagccgatttctgccattcaaaaaacggatatttcaaattatttgaaacaaattcaggcagtgcgaaaaaatctgtctgttccatttcttccagcattgatttgcggtcttccacccaatcaaacaacgttttattattcgccatcttttttctccgcttgattttttactgattgatagaacgcacggcttaacgctttatcgtcatcgtttaagcaacctgcaaattgttcatcgtccatttcggataatgaaacatacatttgatttaaatccaacatttcaagcatcatttgtttttgttcgtcaagtggtaaggtttgaaattcaggttcttcaatgatttgactaaattcattcacgcttacattgtatttcaagaaatagcgttcgcataattcattaaacagcgttttgatgtcgtttgaattttcgcacgccaaaatttgttgttttgctgtttcgttaaatggagcaagttcggcataaacaaactcgccaccgccttgccaattcacggctttggaaataccgccttgctcgccttcaatcacttttttcaagcgttcaacggcaagcgtttcaatataatccatttgttcaataccgatgtattggcggttcattttatgagcgacggcggcggttgtgccactgcctaaatggtagtctaggacgatgtcgttttcgttggttgctgttttaataatttgtgaaattaaacgctctccttttttgccatttttaaaatctacgctcccttcttttccaacatttcccatatcaaggtaaaaaccttcccaccaattaccacgaattttacgaagtccctcatcattattgtaattatcagtttttccccaagaatcttgtagtcttaataattggcaaactttgccatttttatctaatgtaagaatatattttcttccatttctctcaacttctttccatttgctattttctaattcaacggataaatcaaatccagtaactttatcgcttcttacaatcttggaaagatgtgttttcacaatctcggcaaattcattacttttcttaaatgcttcttttaaagaaagtgcggttgtattttttaaatcttttggaaatctataatcatataattctttaagttgcccaatagccccatcgttttttaaatatagcgaatagtgttcatcatattctgaacgcaaatcatacaagggatttattgcaatatttttatgtccattttttgaaaaaactataatatattcagcatttttaacaatatttccatcttgtgccgctttaactttcattccttgcgttgtggacatttggcaatgaatggttgtaacaaaattttcacgaccaaaaacttcgtccattaaaattttcaaataggcttgttcattgtcatcacattgaacaaaaatcacgccatcatcagccaacaatgttttcgcaatttccagccgatttttcataaaagtgagccaagtggaatgattaaatttgtcgttgtatttgaaaccgtcattgcccgtgttatatggcggatcaatataaatcagcttgattttgcctttaaactgcttggcaagcgaatgcagggctatcagattattgcctttgataatgagattttcggctggcgtgccgtcaaaatggcgtttgatttcgccaacgggttgcttgccatctgcggtatagcgagagaattttgagaatgcttttgcgtcaaaaagtcggtcaatttcatcaaaagcaagggtttgattaaaaaagatttcttgtctttttcgggttaatttagtgtataattggctggctggctgttattgcgtttaaaataaatttcttcgccttcttcggtgctttgtccgccatttagcacacaatctttaaacggaaaatccaacacaatatccgaactgtctttcaaaaagcggttgccgtccgtcaagccaatgcgattggcgtattttgtgtaggaattattgattctgtgtttgtccaagaaaaaacgaaaatcctgcaatttaaacaccaaaacaccattcacttccacaaaaaaatggcgttttaactcatcattccccaataacaacccgataatagtcgggtcggttttttctaccaaatccaacagaatgtttttggctaaaatggttttttcttcgttcgcccatactttttcgtgtgatagtagggcttgggttaattcggtttgaatgtctgtcttcatcgttataaatcctcataagtcattattttaatgtgctattacaaaggaatagcagagtgtttaggtatatttatcgaccgtacaggtttaattactctcttaacctgttttctttgactcacagaagtcaaaaaattttgtttatgtgcatcaaattttagtgaaagcattaacacagtattaaaacacagcctttgttaaaccaaattagcattctaaaactgttctagtgcttttttcactggggcaaagctacgacgatgttgcggtaacgcaccaagttcagctaatttttccaaatgtaatttggtcggatagcctttatgctgggcaaaagcgtattctggatattgcttgtctaattcttccatttcttggtctcgtgccactttcgccaaaatagaggctgcactgatttctgccacaaggttatcgcctttgacgacggcttgcgctggaatagctaaatcttttgggatcttattgccatcaaccaacacaaagtgcggttgaatttttaaagattttactgctcgagtcattgccagcaaggaggcttgcaggatatttatctcgtcaatttcgttagcttcagctcgacctaatgcccaagcaagggctttttctttgatttcttcagcaagggctaaacgttttttctcagaaagttttttagaatcagcgagtccttcaattggattattcggatccaaaataacggcagccgtgacaacagccccaactaaagggcctcgcccaacttcatcaacaccagcgatcaattcatagccttgtggatattcaaacattttctgttccttctaataaatcaatgactgcttgagccgcttgcttatcggcattgcattgaatcttttggtgtaaatccgtgaagtgctgaattaaaatatggcgattttttaccgcactttcatcatcagaaagataagcagataatttttcagcgagcaattctggcgtgcattcttcttgaatcatttcaggcacgagcatttcattcgcaagcaaatttggtaaagaaatataatcggttttcactaaacgttttgctaagaaataggtcagtggtttcattcgatagcctaccaccattggggatttacaaagcattgcttcaagtgctgctgttcctgaagcaagaagtgttgcatcagctgcaatcattgcttgtcgtgcattgccgtcaattaaatgcaggtctagatttggcgcaattttagctttaatggcttcaaattgaattcgtcgtttttcgttcaccaaaggaacaaggaattgtaaatcaggaaattgttcttttaacaataaagctgtttttaagaaaggctcagccagaaattccacctctgaaccacggcttccaactaggatagctaaatagcgttgtgcgggatcaatctgtagcatttggcatgcttcggcacggtttggtttgagcggaatagcatctgccattgtgtgtccaataaaacggcaagggacattaaatttatcgtaaaaggctttctcaaaaggcaaaaaggcaagaacttgatgggtcgctttggcaattttatggatacgattttgacgccatgcccatacagaggggctcacgtaatgaatggttttaattccgttagctttgagcttgagttctacatccaaattaaaatcaggcgcatcaatgccgatgtaaacatcaggtttttcttgcaacatagtttgaatgacatttttacgaattttcagcaaacgaggaagatgtttcaagatttcagccaaacccataacagaaagctcttccatatcgacgagcgttttacagccttcagccaacattcttgtgcctgcaataccaataaagcgagcattaggataatgtgctttgagctggcgaattaaaccagcaccgagaatatcaccagatacttctcctgcaacaagagcaatggttggatttgttttgttcatcaaatttatcctaaaaaataaccgcactttggtgtgcaaagtgcggttgaaaatgaagaagttttattaacgaataattccgcgagttgaacgtttgaaaaattcaacaaaaaaactgatcgctgaatcggtttccgcaatttgctcaatttctggtaacacttcttcaagtgttttaccgccacgatagagcattttataaatgttacggattgtgtgcatggttggtttatcaaaaccacgacgtttcaaaccctctaagtttacgccaaatggacgggcgtggttgccttgcgccataacataaggtggtacatcttggcttaccatagaaccaccgcctaacataacgtgtgcaccaacaatcacaaattgatgaatcgctgacataccgccaacaatcacgaaatcatctaattctacgtgacctgcaagcgttgcattgtttgccagaatacagttatttttaatttggcaatcgtgtgcaacgtgaacattcaccattaataaattgttattgccaatagaggttacgccacagccttgaatcgtgccacgatgaattgtcacgtgttcacgaattcggttgctattaccaataatggtttttgtagcttcgcctttatatttcaaatcttggtttacttcgccaatgctcgcaaattgatagatttcgttatcttcgccaatcacggtatcgccacgtaccacaacgtgagatttcaatacagtgcgagctttgatttcaacactgccctcaataatacagaaaggcccaataaaaacgtcttcgccaattacagccccttcttcaacgagggcagttggatgaatttttgcacttgggtggatcatatttaccccttaattaacgacgagcacacattagttttgcttcacaagcgatttcgccatttacggtagcaacgccagtaaatgaagtgataccacggcgttctttaatcacttgaacgtttaattccatttgatctccaggtaacaccgggcgtttaaagcgcgcttcatcaatacctgcaaagtagaatagttcgccgccttttaattcgagagttttaaaggctaaaatgcccattgcttgtgccaaagcttctaaaattaaaacgcccggtaaaatgggttcgcctgggaagtgacctgtgaaacaaggctcattcacgctgatatttttaatcgcttttaaccattcgccttctttaaaatccaatacgcgatccactaacaaaaatgggtagcgatgtggcaataaagtcataatttcttttgattcgatcactcttggttgttgttctgacacgttgataccttacaaaaaataaacaaataaaatctgtcggattatacgatatttatagctaaaaataaaacgtactcaatatgctccgtgtttaggacgaatatcaatggctggatcgtcatctttacgatatttttcatcaattcgtttttgcaatccaaagtcatttttatccgattcgttagaaaataaatcttctgtttgcgttaattgaggattttgaattcctatccaatttgcaatcccttctaagaaatttaaacctgatttaaacaccttatattctttgcgttccatatcatctgatgaaattttgaatagcggaatattatggtgctctcggctgaaacagttttgattgaacaaaagtatattgtttttttcatcttgttggtggcacaaaccgtgatctgagaaataaatcattgagaaagtgcggtgatttttcttcgcattttcttcaagctgatcatatacacgttttaaaaattcatcggttttcttaatagacgacacatagcaatttaaataaccatatttcggattaagatctttatcatcaaaaatttttggataatcttcgatacgatcgcaagccattgggtgtgaaccataaatatgcaacacaataaaacgttttccttgaacagaattttctaatacttgggcgaatttgggtaataaatcaaagtcactaaagttagtcgaattaaagcttccgccttttttcaagaaaaaggtttcatcagattttgaagcgagggatgaaacgggcgtatcgaatttaccgagcataccttgattagaaagccaataagttttcacgcctgcagatttgattagatccactaaactcaagctgtaatttggttcccatttttctttgttaggaagggttagcattagacgaagtgaggcgacggtatttgttcctgctgaacgaaaaccatcaatcaacgtgcctttagcgttagacataaagggggtgttttctattggataaccgtaggcatggtggtaatctttccgcgcactttccccgagtacaattacataatcatcatagcgtgaattttctaatgttgattttccccagttatcagattgagagatttgttttagtttttgcacttcatctacaatttttaatgtggaacttatggtttctttaataggttcggcaagtggcatattgtaggcaaagagcaaggtcgctaaggcaataaatgttttattacgataaaattttatgccaaatttcaccgcacttttgtactgaagaaaaattaaaataggaatggcgaaagcaattaagtaactactcactggaatttgcaatagaaattccttcgtttccaatatatctgtcgcgaaaagcgaggcgatatattgatagcttggagggccaaaatttagccccgtaggtgtataaaaagcatgcagtaacgtaagaggtagcaaaataaaatagaaggattttttactgctgcttaataagagaatagttattgtcgcaagcagaataagatctacagttggttctgtaaacatcccagaaccgattaaaataaaataacccgcgaatgcggcacaaatcaccgcaaaaagtgcgggcaaaatttggcttgtttttttcgtgttcatcattgtcttccctgaaaagaaaatatcgctattatccacctttcactcagaatttccatatttaacttcttcactcttgagcggttattttatagaataagccaatttttttaagccagaaggaaaaaacaatgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcggtgtcgttcttggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaattaatgtccgctttccaattaaatggtatttgcgatacttataactggtctgaagcaatcaaaatgttacgcgaaaaacgcgtagtcattttctctgcgggaacgggaaatccattctttaccactgattctaccgcttgtttgcgtggtattgaaattgaagctgatgttgtgttgaaagcgactaaagttgatggtgtgtatgattgtgatccagcgaaaaatcctgatgcaaaactttataaaaatttaacttatgcagaagtgatcgataaagaattaaaagtgatggacttatcggcgtttactttagctcgcgatcatggcatgccgattagagtgttcaatatgggtaaacctggtgcattacgtcaagtagtgacaggcactgaagaaggcaccactatttgttagtgaatgttgaaaagaataatattaaagaaaatacataattaaattaaggactaaacttttaattcattgagtttagtctttttaatttaaataaagcattacggcaggaatgaaagttttcgtaaattctgtttagtcttcatagttggattatttagatataaaaatctgcacgctaataagtgagaaagttaatcaaacttttagaatgcagattaattttttataaaaagtcagtttaggctacagtgagttgtcccgcatataaaacaaagaaacgtaaacagaataccccaattaagtcaaaaattgacaccaagataataaagttacgattgtattttaaacggtcatttacaaacatattggcgattaatgggatcaagataccgataatcaatactccaacccagaatatcgctccccaaaaaccagataaggcattatgtaaggcaactgttttttgtccgccaccaaaatgtaatccaacgaagaaacacacaatcaaaccaagttctgtcaccataattggcacttcaaatttgtggatgaagtgcgattcgtgagaatcaccttttagttttcctgcaattaagataattaagaaggttgcagcaataccagatgatgtgccagaggctaaaaataatgcgggtaatactgggttattcaacattggatagctaatcaatgcagaaagtaagaaccctgtgtatgcaccaagcactgcagccaatatgaaaagaataacttcgactggacttgcaatacgttctgcaataccgatgagtttcatcacaaattgcagttttggtataaagcgattaattaatgcttcgatttcttttttgaaaatcactacaccccaaattactaaaaataacatatagatttggaatagcatgacccccatcgacattacggagttgaattgatagttaaacatcaatttccagaatgtccaaggtcgagtcaagtggaaaattaatagcgttaaaccaattaatgttggcacagatcctaaaattaccccagatcgaataatccagttttggcttagattttctagtttattactgcgtttataggcaattgctaactgtactgcaccagatgagatccccaataagaacaagtagatcgcaatggtataatcccatactagattaggcgtatgaaatggaactggataatctaacgtcatcttctaggctccccatgttggaatggaatgtgatataagtttggttgtgtacctaattccactttagtgcgataaaccggtttttctttcactttacgtgaaactgcacttgttggatcattcatatccccaaaggttaatgctttggttgggcaagcctctacgcaagcaggttgtttaccattggctaaatttgtatcgcggcagaagttacatttatctgcggtacgatgtactggatgaataaaacgtacacgatatgggcaaactgctatacagtattggcagcctacgcataaatctttatgtacatctacaatgccagtctctttatcaataaaagatgcaccagttggacaaactgctacacaaggtgcatttgtacaatgttggcaagattgacgaaagaactcgtattcttgatttggaaattccccataaggttcactacgtagaatctctaagcgagaaacgccttctggcacttggtttacatcacgacatgagtccatacaggctgtacaaccgatacacgcattttcatcatgtatcattgcgtaacgtttaggtttatccgccttgtcttcttttgcaaaagaaggtaaagatgttcccgtcataaggatcactgcccccatgccagaaacaaagtttcggcgtgagcagactgtcattgtttatccttttgtttggttagtttatcttgttcagctttacgtttttgttgtttaccatggcaatctacgcaaagtttaacgcgttgttttggttgaatacctttcattgcgtcttctttagggtgaagcgtatggcaacttgcgcaaggcaatttcattgcgtgtacatcatgagcccataatttttcacgaagtttgtcaggttgatggcaagcaaaacaaacttggttttgttcttgaactgaatacatcggttttttattaccgaaaatatctccttcaaaacgcataacatctttagcaccgcgacgatgattttcggaaacattgccgtgacagcttacacaagtaatagctttaccgttatttggatttttcttatctaaatgtgcaccatggaatttaccanagtggagttcgccaccagaccgatctagcgtttggtttttatctattttgtcgaatttatggcatttagcacaatattgattaggatcgcgttggttatctaattgcggttcataagtaacatgatccgcaggtttttgtgcatcatccgcataagccaaaaatggcaatgctacaaatgccgcacttaacgctaacgcttttgcagatttgttgattaaagaagttaaattcatttgggttacctcaaatttgaccttgaaaatcaccgcactttccagtttgcactaaaaagtgcggtgcatttttcatttatttttgtgctggtggatcaactaataagcctttttctctagcttgttgctcccattgcggtaccacagtttttaagaattcttcttttgctttacgttctttttcaatatcaatacccattactttccacgctttatcagctgttgaaatatctgggatttgaactggagttttcacaccgtgtttagttaagattacagcaagtttagtgcgcgcgtctgctactttatctaagccagaagctaatacacgaagtactacttcaggcgcatgcatatgaccaccatggcttgcagcagtgtaatcccaacgccattgagcatgacgaatatccattaatgctgcttccatttcttctttagttgcacctgcgtcccaagccgcttttgcttcaaagtgagatttaacaacttggtcttctaaacgacccattacatctttcacttcttttttacgtgaagtaacaatatcgcgtaatttttctttgctttgatcgtgacaatttgcacaagtgtggtcaaatgcatcgaatggattttggatttggtggtcagtataaactttaccatctgcgccttgtactttcggcatatggcaatctacacaagttaccccatttttaccgtgcatacctaaagaccaaatttcaaagtcagggtgttgtgcttttaacattggtgctttagaaagtgagtgagtccagtcagtgaaaccaatatcatcataatatttttcaatatcatctgcggtttgaccattatcccaagggaaagttacttgcttgatgtcccctgcaaaatagtattcaacatggcagtttgcgcaaatttctgcacgtttttcagtacgcgccgccgtgttgaaacttaaattgttgtgtgggcgaccttctgctttatctttttcagcagtggctttttctaaagcatcaagggcgcgtaatacgtgtgggcgagcaatacgtaatgcaggtttgccttcagcaaaatctttagaggttgtgtcgtgacagtcagcacagccaattgagttcacgatttcaggccctccctttgcccatttcgcattgaaataatctttctcaccccattccgcgattaaacgtggaacatcaggacctttacatgtccaacatgccatagcttgagggccatcatttgcagtttttggcgcacctgtacgtaaaatattacgcacatctgttaccgcataaaagtgaccgcgtggtgcgttatattcttttgcaaatgcataaccaccccaaagtacgattaggcgcggattttcttcatcagcataaataatgttttcgccatcgccgtttgctgtagaacgccagctgttatattgatttggatatttttctgcaaatttttcatttacagattcaattttcaaatcaggttttgcgggttcaacaggttgttctaatggcttatatacaagctcagcagtggctgagttaaataagcttaaactcgcgaaagacgctgccacaataaggctttttttgaatgcgttcacgataattactccatttgttgtaataaaaaggttaagtagaaagttgagaattattattaatatccatacaaaacgtagatatattttcattcaagcgtaagataccaaaagaaaaaagtttttctactcgcagaatgctaaagtttgagcttgatcaagcttatcttttaaaatactcaaaaagaggtatattgttattttgaataaattaaggcggtataaaaccgccttaattttgagtattattatcattagtattgactaataatatttgctattcttttatctgatatttgatattttgtccccaactgctgggcaaataaactcacacgcaattcctcgatcatatagcgaatttccgcaatttcatcagaaatcggtttagattttggcagtttagccagtaattgttggtaagcctgttgcacttgttccacgcgtagcatcgcagcacgatcacggtttacatcttgagccaacttatcaatacgtttatcaatggcttgcagataacgttgtaaatctggtaggcgatcataaccgctcttttgcacaaaaccttgatacaccaaacctgcaagttgcgatttgatgtcggataatgcaaatgccatcgtgaaatccattttgcctttaaggcgttggttaagttggtaagtgagagtaagaatctgctccactttctgcgcaatatccacggtcacttcgttaaggttttctcgaacgaaatcacgcaatttttcaaatcctgcttcatcccacacaaaaccgccaaaattggcaattagcttatctacggcacaagcaatacagtcatcgatcaaatccaatacgcgaccgaacggagtaaaatacagacccaatttagccttattcggcaatttttcatgaagatatttaattggtgatggcacattgagcaataacaaacgacgtaaaccttgttgcatcgccaccgattgctcaaactctgtttcaaacagtttgatacccaccgcatctttttcatctacaatagctgggaacgctttgacgctgaaaccacgttgtttttgttcataacattgtggtaaatctgcaaagctccaaatatgcagcctgctttgctcaatgccatcatctgccacagcagaaatactttcctgcacacgatcttttaagttgaatttcagctcatccaaattcatggattctgcgattttcttaccgttttcatccaccacacggaacgtcattttcagatggcttggaatttgttcccaattccaatgttccgcttctacggtgacgccagtcatacgacgcaattcataaatcagcgtatctaataatggcttttccaacggcaccgcacgacttaaaaaagcttgagtataattaggtgcaggcacgaagttacggcgataagatttcggcagcgatttaatcagcgcaatcaccaactcttcacgcaagcctggaatttgccagtcaaagcctgtcatttccacttggttgagcaatggcaatggaatatgtactgtcacgccgtccgcatcggtacctggttcaaattgataagtcaatttgagttttaaattaccttgataccagaaattcgggaaatccagtttgctcacttgttccgcatcatcattgatcaaaaatgaacgttcaaaattaagcaattcaggatctttttgctgcacctttttccaccacgtatcaaaatgcttctgggaaaccacttccgtgccaatacgctgatcgtaaaattcaaacaatgtgcgatcatccaccaaaatatcgcggcggcggcttttgtgttccaattcttctacttcttgaacgagcctttgattttctttgaagaatttatgcttggtattccaacccccttccaccaaggcagattgaataaaaatctcacggcttaccgttggatcaatagcaccgtaattcactggtctcgcagccacaatcggcacaccgtaaagtgtgactttttcatctgcaatcacggcgccacgggatttcgaccaacgcggttctgaataggattttttaatgagatgctcggcaagtggctcaatccattctggctcgatttctgccaccatacgcccccaaagtttggaggtttccactaactctgccgccatcacccatttcggttgttttttgaaaagcacagaattggggaaaatcgcaaaatgggcattacgtgcgccaagatattgttgtttctccgcttcttttaaaccgatatgagaaagcaaaccgcttaaaagtgcggtatgaatttgctgatattctgctttttcagaattaatcggtaagcccatttcacgcacggttaaacgaatttgatgataaatatcctgccattcacgaatgcgtaaataatttaagaaatccttttggcactgacgacggaattggtttttactcaattctttttgttgttcttgtagataataccaaagattgaggaaagccaagaaatctgattttttatcggcaaaacgacgatgtttttcatcagaagcttgctgtttttcttgtggacgctcgcgcggatcttgaatggataacgcagagacgatgatcatcatttcataaacgcagccaaaattgaccgcacttaggatcattttggcaaggcgcggatcgactggaagttgagcgagttggcgaccaactctagttaataggcgtttttcacccgatttagtttgaacagtttcaaacgcgcccaattcttccaacagttttatcccatcttgaatatggcgtttatctggcgcatcaacaaatgggaacgcttcaatatcatccaaacccaatgccgtcatttgcaaaataacggaggctaaattggtgcgtagaatttcaggatcggtaaactctggacgagaattaaaatcctcttccgaatataaacgaatacaaatcccttcacttacacgaccacatcgacctttacgctgattagcagatgcctgtgaaataggttcaatcggtaaacgttgtactttggtgcgatagctataacgggaaatgcgcgctgtacctgggtcaatcacatatttaatgccaggtacggtcaatgaggtttctgcgacgttggtcgccaatacaatgcgatttaaaccgcttggatggaaaattttattttgttcttgcgcagacaagcgtgcaaagagcggtagaatttccgtgtattttagattttgtttttgtaaagcttcggcggtatcacgaatttcacgctctccattcataaagatcaagatatcgcctcgaccttctgcttgcaattcatccaccgcattgagaatgccttgtagctgatcttgatcgtcctccactacgggacgataacgcacttcaacaggataggttctgcctgagacttcaatgatcggtgcattattaaagtgtttggaaaagcgttccacatcaatggttgcagaagtgataataagttttaaatcacgacgacgtggcaacaactgtttcagataaccgagaataaaatcgttatttaggctacgttcgtgggcttcatcgataatcaaacaagaatattgattgagaaaacgatcgttttgaatttctgctagcagaatcccgtcagtcatcaatttgatttgggtgttatcgctgatttgatcgttaaaacggactttataccccactaaatcgccaagttctgtttccagttcttccgcaatacgtgccgccaccgaacgagcagcaatacggcgtggttgagtatgaccaatcatgcctaaattgccgaaacctaattccaaacacattttcggcaattgggtggttttacctgaaccagtttcccctgccaccacgatgacctgatgttcagaaagcagtttttgaatttcgactttgcgttggctaacgggcaaactctctggaaaaataatcggattttgtaccgcacttttccgttgttctacacgtaatctagcttgttcaatttgctgttggatttcagcggcaacggcttgttgagcctcttggcttttaatttttccaataccatgaatgcgggcggataagcgacgttgatccacccgcatgatgtcatttaattgagaaaaaagagattgttgtaagggagttaatgtgtgttttaccgagctgtttttcatagcgatttacttttgaaacttccgtaagctaagctaatccatccgattaaaaataaagtgccgccaataggcgtaatccatacaattacattgcttgcttcgaaagcaagtgcgtataaacttccactaaataataagattccaattaaccaagaagacatagataatcgggcgaatttattgtcacgtaaagcagataatgcaacggcaagtactgcaatggtatggaacatttgatattctaaccccgtatcaatccatgataatgctttggcttctaatatatggcttaggccatgagctgcaaatgcgcctagtgcgacacagaagaatccgcttaaagtggcaatagtaaggtatttgtttttcatttaaattttccctaaaagtaaagctaatatacctgcagcaataagtgggccaacgggaattccacctaaaaatgctacaccaataattgtgccgataagcaagccagtgactaaaatcggttgttcgcccattaaaggcacacctttacctgcaagccatgccacaagcactccaactgcaatagaaagagccattttccaactaagaaaacctgataaatcaggcaactgaatttttcctgaaactaaggggcttaaaaccccaatggttaaaataatgataccaattttaacgccatatttttcgagcaaaggaatatgagaagataaaaaagtttgctgcatgataagtaatacggcagcagaaatggtaattgcgctgttgttgcttaatacgccaagaataagaagtatcactagtaatagagcaatggtattgagttgtaatgtcataaagtgcggttaaaaaaatggaaattttggtaaatattctagcatagaaattcgtaaaattattttccattgttgttgagaaaaagataaatgagaaaagttaaaaagggttcattatgaacccttttatttagtcggtaaaattcttaaatcatttattcttcaaatttaccttttttttctttattgatggtgcattttgcactagcccaaattgcaaacaatacacccactacccaaatcgcatataacattctatttctccttagtataatgagtgtttatttttatcaatgaaattagcatctaaacgaccaaacatttttgagtaagaccaaatagtataagctaaagcaatgaccacaaaaacaactgcaaaaatcagcattaatgttaatgttaattcacttgaagtcgaatcccacattaataaactttgttcaggatgtgaacttgaaggcatcacaaatgggaacattgatactgctgcagtaataatcacaccagccattgttaatgcagagaagaaaaatgcaaaaccacaacgattcgctttagaaaatgcagcatttaataatgcagcaactacagctaaagcagggaaaatccaaagaattggcatttcattgaaatttctaaaccacgcgccagtttctacagcaacttctttattcattggagacgatggagcgaaatgatcgatagtgctagtaactacataaccatctttagaatataaccatacgccagctaatacgaatgtaattaaagtcacaatagaaccaatttgacttactgaacgagcacgatcacgtaagacttcagtggttttcatttgtaaccagtttgcgccgtgagtgacaagcattgataagctaataacaccacataataatgcgaatggatttaatagctcaaaaaatgaacctgtataagtcacttgagttaattcgttaaaatggaatggaacgccttgtaataaattaccaaaagccacgccaaatactaatgctggtacaaaaccacctgcgaataatccccagtcccaaacagaacgccaagttggattatcaatttttgcacgatattcaaaacccaatggacgtaagaataacgctgccaagactaatactaatgcaatgtaaaaacctgagaaagatactgcatatacaattggccaagctgcaaatattgcaccacctgcagttaataaccaaacttggttaccatcccaatggggagcaatagtgttgatcataatacggcgttccacttcttttttacctattacaggtaaaagtgcagtcacgcccatatcaaatccatcagttacagagaagccaatcaataatacaataactaacacccaccaaataaaacgtagaaattcataatcaatcataatttatctcctacttatttagctgattgttcaaagtagtatttgccggtttttaacgcacttggacccaaacgcgcatatttaaacatcaaatacatctcaacaataatgaacgcaagataaagcgcacaaattaaaccaatggagaaccataaatcgcctgtacttaaattagaagcggatacgccaacaggtaagatctcgtaaatagcccaaggctgacgaccatattctgctaagaaccaaccgcactcaatggcaatccaaggtaatggcaagccccataaaagaacttttaacaataatggaatttgagtgactttattacgtaaattttgaacaaatgcgccgaatgtaagtaaagcaattaaaccaccagctgcaatcattgcacgaaatgcccaaaaattagggcctacatttggaatagtatcacgagcggcttgtttaatttgttcttctgtcgcatcaacaacattgtttgtatagcgttttaataataaaccgaaaccaagatcttttttaacttcattgaattgtgctttggtttcttcatttacttgaccatttgcttttttctcagcgcgtagttgagtaaataattcataagcacggataccactacgtacacgagtttcatttaatgcttgaagatcttttagacctataatttctttatcaattgaacgagttgctattacaccgccaagataaggaatttcaatcgcaaaatcatttttcatttcagccgtatttggaattgctactggaaggaatggagcaggtgctggatgagtttcaaattcagcttccattgcggctaattttactggttgtgctttaccaatatcataaccagattcatcaccaagaattagcactgaaatagaggcgataaatccaaaagtagcagctacggagaaagaacgttttgcaaattcaaaatcacgaccttttagtaaaaagtatgagctaatggctaaaacaaaaaatgcgcctgtcacataacctgcagaaagagtatgtaagaatttactttgtgcaacagggtttaaccaaagatctaagaagttagtcatttccatacgtacagtttcaaaattaaattttgaacctgttggtgcttgcatccagccatttgcaaccaaaatccacatagcagataaattagaaccgaaagccacacaataagttgctaataagtgttttccttttgataaacgatcccaaccgaagaaaaataaccccacaaaagtggattctaagaagaaggcaagtaacgcttcaatagcaagtggcgcaccaaaaatatcccccacgtaatgagaataataagaccagttagtaccaaattggaattccataataataccggtggtcaccccaagggcaaagttaataccaaataactttccccaaaattttgtcatatctttataaacttctttacctgtcgccacataaatagtttccataattacaagaataaaggataaacccaatgttagcggcacgaaaatgaagtgatacaacgcagttaaagcaaactgcaagcgagaaagatcaacaacgtctaacattctcaactcctttgtataaacaacattagttccaacaatgattaacaaggcgatgccttaaataatccctaattactcaactccaatcagctaagtttatattgacttatctacataattatttttaaaggttaaaaaaacaccagttattatagagataatccaaattggcggctattctactactaaacataaggataaaaaatagtaaaaaatgctatatagatcacatttttgatataaatacaaaaatagggcttatttgttatatttcatttaattgatttagatcaaattgacatttttgcaataatttttgttttaaagatgattaatttcattgtgtaagatcatattttaatatttgtctcaaccaacatcatctcttgatgtttttaactgcttgaataagtatgtagtggcatttaatacttaatttatcattcaacatttgtaatgtaattgttgatcctttccaaggataaaaaggattaagccaaaactagcattgagttcattgcgcaaatcaggtaaactaccatcccgtctttgatagctaattatcttcgatttttgaccgcacttttggttgattttgtctgtaagatgattagctataatcatttatattccaatacagattaggttccctatggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggggaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagcaagccaatccagtgggagaagtaaccatcggtatggtaggtaaatacactgagttacccgatgcctataaatcagtaaatgaagccttaaaacacgcaggtttaacgaaccgtttaagtgtaagcattaaatatattgattcccaagatgttgaaaccaaaggtgttgaagtattaaaaggcgttgatggcattcttgttccagggggatttggttatcgtggtgtagagggtaaaattcgtaccgcacaatatgcacgagaaaacaaaattccttacttgggtatttgcttaggtatgcagatcgcattgattgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaacaatgtcatttggtatcaggtagccacgctcgtgagctttatggcaaagaaaccattgaagaacgtcatcgtcatcgctatgaagtgaacaataccttgcttccacaaattgaaaaagcaggattgaaagtaactggattatctgcagataaaaaattggtagaaattatcgaagtgccaaatcatccttggtttgtcgcttgtcaattccatccagaatttacttctacgcctcgtgatggtcatccgttgtttgcaggctttgtaaaagcagcctatgaaaatcacaaaaaatctgtgaagtaattcttggttctgcaataagtgcggtaaaaaaatgaaatatttttatttggttatgatataacttgatgtttttgaagtaaaaaaatccccgttaaatttatcatttaacggggattttttataagctatttactgtttttatatttagttagtacgcttaactaatttcgtccagttataataaccatacaacgagttaagtaagtaggctgaatacattaagtatattgcaggtgtctctgcccataagaaaatagaaagaatatttaatccaatccataacaaccactgttcacgataacgtaaaatcattaaaatctgtgccgcaaccgtaataattgtagttagaccatctaaacctgttgaactaccaccagcagcttgtaatgcttgaacaaaaagcaaagtgccaaccgtagtcataacaattaatgtcatccatcctttaacagttaatgcttttgcaatcacgctttctccaccatcgctattttgcatattggctttccacataaagtaaccaataaattgagagggcaaatatacgtaaagtacggtgttcatttcgcctaagaaattcgatccccaagcaacataaaaataagtataggcaaaaatcaatccaaagaaataattactaattttacctttacttaccaataccacacacaaaatacccgagataccagaaatcattgctaaccaagaatcaggtgtttgtacataagcccaaatttgcgcaatgataaaaagcgcaagccaaaccacctcaaaaggtttccaaccagaaacaaattctcgttttaaacgcgctgccaaagtcattatttactcctattgacttaaattttaacgggagcattcttattcttgcatagggaattggtaatgtaaaggtgtagaagcatttaattctaaagttgtgaaatccatcacgttttaattaaagcctacattatccattatggagtttgtttcaaaaaacgctctaaaaattgaccgcactttaaatataataatcaagctcaagtggtatttttgcttgtaacaagaactgtttagtgcgctcgtgttgtgggcaagtgaagaatttatctgccgtattttgttctacaatatatccatccgccattaaaatcacacgatccgcgacatctttcgcaaactgcatttcgtgagtaacaataatcattgtccagccttcttgggcgagcatttttagtgtttgtaacacttcgcccaccaattcaggatctaatgccgatgtaggttcatctaataaaataatatcaggttttaccgcaagggctcgagcaatccccactcgctgttgctgaccgccagaaagttgggatggaaataaatccgctttatttttaagccctactttttctagcaaactaagtgctttttcacgagcttgagctttatcttgtttttgcacaacaaccattccctccataacattttcaagggcagaacgatgagggaataaattgtattgctgaaagaccattgatgaacgtcggcgtaacttcaattcatctgctttactaattttctggctaaaatcaatttttagactgccatcagtaaattccaaaatgccttgctctggtcgttcaagcaagtttaaacaacgtaaaaaggtggtttttccagaaccagaagggcctaaaattgcgaccacttcacctttattaatttcaaaatcaatgccttttaacacatgattgccattaaagtttttctgaatattacttacttttaacatagacattccttataaatggcgagataagcgaatttcaagacgatcttgtaagaaagataaaacaaaacagaaaatccaataaatcaaagctgcctcactataaattaaaataaattcatagttcgctgccgtaatattctgtgcgacacggaataattctgtcactaaaacaagagaagctaatgaagtgtctttcactgtactaataaaagtattagaaagcgatggtactgaaatacgtaaagcctgtggcataattgtacgaataaatgcttgtcgataattcatacctatcgcataagaggcttcccactgccctttaggtatagcaataattgaagcacgaacagtttctgctgcataagcacctatattaatagaaaatgcaataatcgctgtcggaaaaggctctaaagtaataccgacttcaggtaacccataaaaaataataaaaatttgtactaacatcggtgtacctctaattatagagatatacactcgacataaagcctgtaacaattttaagggtaaattagggctaggcaaagtacgaataactgcaacaatcactgcaataagcaaaccacagaagaaggaaatgactgccaatggcaatgtgtataaaattgctgcttccaacataggccaaaacgagctgattacataatcagctcgttctgcactcataaatggaagactcgccaaccaattattgagtaatatcataaccaaaccattcaattgaaatctgttttaatgtaccatcttggcgaagtgcttcaagtacttgattaaattttgtaatcaatgcatcttcaccttgtaaaaaagcaaaggcagtcggagttttatccccacgatcataagcaatttttaaaccagaatttgggtgttttttaaaataatctaatacagccaatttatcattaattgttgcttctgcacggccttgtttaataagctctaagctctgtgctaaaccatccactacaagaatctgcgcacctgcagcttttgcatctttaccccagttacttgttgcagattgcgcagatttacgacctttcaaatcttcaaatgatttaatactgttatccgatgattttgttacaatcaccccaccagaataattataaggcgttgtgaaactgtatttttttaaacgctctgggcttgggttagtttggtttgcaatcacatcaaaacgttttgcatttaaccccgcatacattgcatcccattgtgtttctttaaattccactttcaaaccgagcttttcagcaactttacgaataacctctacatcaaagcctgttaattttccacttttatcatggaaagtaaatggtgcataagtcccttctgttccaactaataaagttttcgttttttcaacacgatcggcaatttcgcctgcgtgagaaaacgttgagaaagcaatagctccagttaaaagtgcggtcgtaaaaagtaattttttcattttttcttccttgtgttgtgtttgtctaagcgtgattataaaaaccaaacttatgaaaaaaaaagattatttatttatggtttataaattttagttataaaaaattgatataagtgattactatcaaaataagaaaataatctaccgcactttcttgtagaaaaatacgtttctaaacaatgcaatcaatctactcttataaaatttcagtaaaaaaatgcctttctaaagaaaggcattaatagaaatttaagattataaataaacttgtaatttattatagaaaagtcgcgtacctaattacgcttcatcacttctagaaaaacgttcaattttcgcacctagagcacgtaatttatcttcgatatgttcataaccacgatcgatatgataaatacgatctacaatggtttcacccgttgcgatacaacctgcaagcactaaactgattgaagcgcgtaaatctgtcgctattacctctgtgccagacaattgttcaaccccgtgacataccgctgtattcccttcaatttcagctttaccacccatacgaattaattcaggaatatgcataaaacgattttcaaaaatcgtttcagtgataatgcttgtaccttctgccaccatatttaataaagtaaattgagcctgcatatcagttgggaaccctggatgtggtgcagtacgaatattcactgctttagggcgattaccaagcatatctaaagtaatgctattttcagttacatcaacttgcgcaccagcttcacggagtttatcaattacggcatctaaagtatccgctttagtattttgacaaacaacacgaccgcccgaaattgctgcagcaattaagaatgtacccgtttcaatgcgatctggcacaatactgtgctcacaaccagttaaacgttcaacaccttcagtcgtaatgtgatcagaacctgcacctgttattttcgcacccattttattaaggaaatctgcagtatctacaatttcaggttcacgagcggcgttttcaataacagtcgtacctttcgcaagggttgctgccatcataatagataaagttgcgcctacacttactttttctattacaattcgagttccaacaagacgatctgatacttgtgcttttacatatccttcttcaagaacgatgtccgcacctaatttttctaaaccgctaatgtggagatcaacaggtctagctccgatagaacaacctccaggtaatgagacttgagcttgatggaaacgagcgactaaaggtgccaatgcccaaattgaagcacgcatagttttaaccaattcataaggtgcagtgaaatgattgatattagaggcatctaataaaactgcaccagtttcatcacgatttgcaattacgcctaattgacgcaaaatatttaaagttgtttcaatatctttaagttcgggaacatttgtcaatttaacaggttctgtagctaaaatagccgcaaaaagaattggaagtgcggcgttttttgcgcctgaaatattcacacttccacttaaacgagattgcccataaacacgaaatttatccatttttaaatccttaattaaactggtttaatgcacgatcgcgtttccatttttctacggtataagttttgatggttagagcgtgaatttcaccagtgctaaaataaggcattaaaggggcataaatcgtttgttgttgttttacacgagatagtgcagcaatttcatcactcactacaattacaccaaaatgtgcattttcaccttgtgcatagacttctacgatatttagcgtgtcttttaaaatttgttcaattttttgaagttccattggatttccgtttaagtaagctatgtaaaatttgcgatccaatcagataaaccaacaagatctgctagggttaataattgttttggtggataaactaatcgtactgttttgttaatcttttgacactctcgtaaaaaatcacaaagagctgtaaaaccagctgaatcaatatgctgaagaccagataaattccattcaacaatagttttatcaagtgtactttctgacaaaaaaacgccacgttgctgccacattggtaacaaggtgctgcgagatagttccccaaacaaaaagagcgttattttatcattatttttttgcaaatcccaatttagcatagttattcatttattgattgaaaattataggttgtgaggcagattgctgcatctttgtgattaatgtatcaataccttgtttgtttaaaataccaacccaattttttatcgtatcttccagcatacttacgcctgctgctgccatatcgtaggctttccattccccacttttattgcctttacgccatttaaaatctaataggatcggagcaacgccattagtttgaataatacttacgcgaatatttacaaaattgttatcgcctaattctttttctgattcaatttgaattttttgattagaataatttgttaatgtttgtgcgtacttttgctcaatcaactcaccaaaagtcttgaaaaatttttctcgttgttctgtagaggttgatttgtagtatgaacctaatactttagaacctgcatattctaagtttacgtaaggcaataaatcattacgaacaatagtacgtaaataatttggatcttgtttaattttactttgattagcttgtatatcagaaaatagtttatctgacgcttgctgcattaaaacataaggacttgtttctgcaatagctgttcgtgtaaccaaaagtgcggttaatacgaaagttaaaatagtaaaccatttttttagttgagtaaggtacattgtcaatctcctaatttataaaatttaacctattattctgcggattctgatttttcattgccgtctgattttttacttccgtataagaattgcccaattaaatcttccaatactatagctgatgtagtgtcttgaatttgactaccatttttaagcattgctgtatctccatcatcaaaacctattgtcaaggcaatatattgctcacctaataaacctgatgttttaattgataaagaactgttttctgggatttcattatattcttgattaatcgcaatacttacttttggtaaatagcttttttcatcaagcgtaatagcactcacacgcccaattactacgcctccaatttttagtggtgcgcgcactttaagtccgccaatattattaaaaattgccgtcacggtataagatttcgtctcagcaaaaccttgtacattagctacgcgtaaacctaaaaaaactaaggcaccaataccaagtaataaaaataacccgacccaaaattcatatttaattgtttgtctcataaaaaatccttaacttgcgccaaacataatagcagtcaaaataaaatctaatcctagaacaacaagtgaagcgtgcacaactgttcgtgttgtagcttggctgataccttctgatgttggcatacaatcataaccattaaaaagtgcaatccaagttacggctacagcaaagaaaaccgctttaataaagccatttaaaatatcatagctccaactcacggaattttgcataacagaccaaaagctgcctgaatcaacacctttccaatccacacctactaaggaactgccccaaataccaatcgcgataaacaagattgacaaaattggcatggaaataacccctgcccaaaaacgaggtgcaatcactcgacgtaaaggatcaacagccatcatttcaagactagaaagttgttcagtggctttcattaagcctatttcagccgtcaatgcagaacctgctcgaccagcaaataaaagtgcggtaacaacaggccctaattctcgcaaaagagaaagtgccaccaactgacctaaacttgtttcagcagaaaaatcaactaatacgacataaccttgtagtcctaataccattccaataaataaaccggacaacaaaataatgagtaacgattggacacctaaaacatgcatttgcttcacaagcaaaggaaaatgcttacgaatttgtggcttgccgatcaatgcaccaaataacataaagcctgctcgccccaatgcacggaaaaagtcgatcacctgttttcctaaagcagaaataaaattgacgatcattcaaacaattccttcatataatcttgcgctgggtacttaaagcgcacaggaccatcagattcaccttttaagaattgcaccacgcgcggatcttggctttgtaaaagctgctcagatgttccttctgcgatgactttttggtctgcaataatataggcataatctgcaatactcaatacttcctccacatcgtgtgacactacgatagaagtcaaatttaacgcttcatttaatcgtttaatcaggcttaaaattacgcccatactaatcggatcttgccccgtaaatggctcatcaaacataattaaatcagggtcaagcgcaatagcgcgcgctaatgcagctcgacgagccataccaccggaaagttctgaaggcatcaatgcggcagcacctcgcaacccaaccgcctccaatttcatcaacacgatttgacgaattaaactttcaggcaaatgcgtatgttcacgaattggaaaggcgacattatcaaaagtagaaatatccgtaaaaagcgcacctgattggaataacatccccatccgcttgcgtacttcgtacagttcacgattagatagacgacaaatatcttgtccatcaaacaaaatttcaccttgctctggcattagttgcccacctatcaatttaagtaaggtggttttaccaatccccgacggccccatgatcgcagtgatttttcccttttttacttgcaaattcaggttatcgtaaatcacgcgatcaccgcgtttaaaggtgagattcttaacttcaattagattttgattcattaaaatctcgtttataaataaaaagttcaatcagttttatatgaccttaaaaagttagattcgtttaatttaaagattaagttttgttatttatagcaacacatttttttggcttaactttaatgtggtcataaaaatagttataaaaaatagtgataaattctatttttaataacttaaaattttgccatagtaacattctttttgacctcactaaagaagctttacatttcttcattatttattgaattttaataatactttgtttatggaaaataaacattgataaatgcctataaataataagcctgtaaaagatacagatttgataaaaaagattgcaaaagaaaagttatagagaggaaagcagaaaaacctaacttttgctaggttttcctatgtttattattttgcacagttacagtgtgctgttttttgttcaaaacgttctgcaacgaaatcccagtttaccacattccagaattctttaatgtagtctggacggcggttttggaattttaagtagtaagcgtgttcccaaacgtctaaacctaaaagtgggaaaccctcacaacctgccacttctttacccattaatgggttatcttggtttgctgttgatacaacggctaatttaccttcagcggttaatactaaccatgcccaacctgaaccgaaacgagttgctgctgctttttcaaactctgctttaaatgcatctacagaaccgaaatcgcgttcaatcgcatcttttaatgcgccttgtaaagtagtgccttttttcaaacttttccaaaataaactgtggtttgtgtggcctccagcattattacgtaatgctccacgtttttctgcaggaattttatcaaggttagaaattaaatgacccggatacatttctactaattcagcaggtaaaccttctaatgcagcatttgcattgtttacgtaagcttggtggtgtttactatgatggatttccattgtttgcgcatcaaaatgtggttctaacgcattgtaggcatagcctaattcagggagagtgtaagacataatgtattccttctattgttaaaaacagatttcgttgaggttttggtctataaccaaaattgagcaaataatagcaaaaaaattgatttagatcattaaatgtttttccttttttaaaaagtgaatttattaaattttgttttaaatcaataaacctatcgatctacttctaaagagttatgtgtttgagttgcgaaaatttcatcaaatattagaataccaccactttctattttccctctgtaattatgtttgagcaacacaagttatctctgcaaaatttatcctgccaacgtggtgagcgcgtactttttcgtgctttgacttgcgattttaatagcggtgattttgtacaaattgaagggcataacggcataggtaaaacgagcttgttacgtattcttgctggtttagcccaacctttagaaggcgaagtgcggtgggatgctgaagcaatttctaaacaacgtgaacagtatcatcagaatttgctttatttaggacatcttttaggcgttaaaccagagctaacggcgtgggaaaatttgcagttttatcaacgaattagtcaagctgaacaaaacaccgatatgttgtgggatttgcttgagaaagtgggattattagggcgtgaagatttgcctgccgcacaactttctgcaggacaacaaaaacgtatcgcgttaggtcgcttatggctgtctcaagcgcccttatggattttagatgagccctttactgcgattgataaaaaaggcgtggaaattctaaccgcactttttgatgagcatgctcaacgtggaggtattgtgttattgaccagccaccaagaagtgccaagttctcatctgcaaaaattgaatttagcggcttataaagcggaataacttaatgatttttttagagataattaaacgagaacttcaaattgcaatgcgcaaaaatgcggagattttaaatccgctatggttctttttgcttgtgattactttgtttccgcttgttattgggccagagcctaaattactttcccgtatcgcaccgggtatcgcatgggtagcagcattactttcagcattgctttcttttgaacgtttattccgtgatgattttattgatggctctcttgaacaattaatgctaactgcacagcctttgccaatgacagctttggctaaagtcgttgcacattggttgctcactggtttgccgcttattttgctatcacctattgccgctttgttgctttctcttgaggtcaatatttggtgggcattggttttgacattgttactgggcactcctgtattgagctgtatcggtgctattggcgtggctttaacggtgggattgcgaaaaggtggcgtgttgttgagtttgcttgttgttccgttgtttattcctgttttaatttttgcttcatcaatactagaagcagcaggattaaatgtgccttatgggggacaactggcgattttaggtgccatgatggttggtgcagtaacgctttcgccttttgccattgctgcagcgttgcgaattagtttagataattaattttatttcattgtataaaagtgcggtggtttttctctttaatttttaaggatcttttttatgtggaagtggttacatccttatgcaaaacctgaaactcaatatcgtatctgcggtaaattgagtccgttatttgcatttttaacgcttatcttactcggtattggcattgtatggggcttagcattcgccccagcagattaccaacagggcaatagtttccgaattatgtatgtacatgtgccgacagcgatttggtcaatgggtgtgtacggttcaatggcgattgcagctgtggttgccctagtgtggcaaattaagcaagctcatctcgcaatgattgcaatggcgccaattggtgcattgtttactttcttatcgcttgttacgggggcaatttgggggaaaccaatgtggggtacttggtgggtgtgggatgctcgcttaactgcagaattgattttattctttctttatcttggtatcttagccctttattctgctttttcagatcgtaacataggtgcaaaagcggcggggattttatgcattacaacggtcgtgattttaccgattattcatttttcggtggagtggtggaacacattacatcaaggggcgagtattaccaaatttgaaaaaccatccattgcaattccaatgttggttccattaattttatgtatcttcggttttttgaccttgtatatttggcttactttagttcgttatcgcgtggaattattgaaagaagatgcaaaacgtccttgggttaaagcattagctcaaacactgaaataaagtgcggttagttttttagcgattttttataaggaatattttatgtttttccaaacttggagtgatttttttaatatgggtggctacggtttttacgtatggttatcctatgcagtaagtttagtggcagttattgccttaattgttcaaagtgtaaaacaacgcaagacagtgttacaaaatgtattgcgtgagcaacaacgcgaagaacgtttacaacaagcaaataaggggaacacactatgaatccaagacgtaaatccagatttaaattagtcatttttgttgtgctcggcattgctattgcaagtggattgatgctgtatgcattacgtcaaaatatcgacttgttttatacgccatctgaagtgattcaaggtaaggataataatccgaatcaaaaacctgaagtggggcagcgtattcgtgttggcggtatggtggttgaaggcacggtagtgcgtgatccaaaaagcttaaaagtgcggttcgatttaaatgatattggtcctgcgatcactgttgaatatgaaggcattttgccagatcttttccgtgaagggcaggggattgtggctcaaggcgtattaactcagtcagcggttttaagcgcgacagaagtattggctaaacacgatgaaaattatgtgccgccagaattaggcgaaaaaatgcaaaaagtacataaaccaatggggattaaggcagcagatttaaaaggcgaaagtgagcgtgatcgtcaagaaaaagaaggcgcaaaatgattgctgaattaggaaattatgtgctggctttaagtttagctgtatcgcttatgttggcgattttccctttgtggggggcggaaaagggcaatgtacaattaatggcattagctcgcccaatgacttatggtttatttgcaagcctaagcattgcttttgctgcgctattttatttattcgcagtcaatgattttagcgtgcaatatattgtaaataattctaatactactttacccatttattatcgtttatctgcggtatggggttcccatgaaggctctttgttactgtggatttggttactggcggtttggtcatttgccgttgctttattgagtaaacatttaccccaagaagcggttgctcgcgtgcttggtattatggggattattagcgtcggttttgtattgttcgtcttgtttacctcaaatcctttcacgcgtactttccctgatttcccagtagatggaaaagaacttaatccaatgttgcaagatgtaggcttgattttccaccctccattactttatatgggctatgtgggtttttcggtggcatttgcgtttgcgatagcatccttaatgactggaaaattagattcagcttgggcgcgttggtcacgtccttggacgcttgctgcttgggtgtttttaactttaggtatcgtactaggttcttggtgggcttattatgagcttggctgggggggctggtggttctgggatccagtagaaaactcatcgtttatgccgtggcttgctggtactgcattgattcactctctttctgtgacagaaaaacgaggttctttcaaagcttggacggtattacttgcgattttagccttttcactttgtctgctcggcaccttcttagttcgttctggtatcttagtttcagttcacgcatttgcatcggatccaactcgtggtttgtatattttggcttacctcgttgtggtaattggcggttcgcttgcactctatgcgtataaaggcagtcaaattcgttctcgtgataatgcagaacgctattcacgtgaaagtatgttgttattgaataatatcttattaatgaccgcactttgcgttgtattcttaggaacgttgttaccactcgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatcagcgtatttgttatgctgattgcaggttttgcgttaccttatttcttgcaagataaaattaccgtgagttcagtgcttggttcaatgatgactgtgattattgtgttacttgtgctttatgaattgcaacaacgtgcgacgcatcgtgaatcattctttgttggcgtacgcaaactatctcgttctcattggggaatgatgttagctcacttaggcgtagctatgactgtttgggggatcgcatttagccaaaactttagcgtagaacgtgatgtgagaatgaaagttggcgagaacgcacaaattggtcgttacgattttaaattcgctggtgtgacggatgaaaatggtccaaactatattggtggaaaagctcaaattgatatttcgaaagatgggcaaccagagacaagtttattcgcagaaaaacgtttttacacagtaagtcggatgtctatgacagaagccgcaattgctggtggtttaactcgtgacctttatgtggcacttggcgaaaaacttgaggacaattcttgggcgttacgcttatattacaagccatttattcgctggatttggattggcggcttatttatggcgttaggtggattgttgtgcatgttcgatcgacgctatcggtttaatgtgttgttgaagaaatagtttatactgccatgggtaggtatacccatggctaattgaaatggttcccctttggggaatttcaactagcctcaaagaggctatacttttactagcctagggtatacttaccctaggcactaattttaaagtgcggtaaaaaatgaaaaaaaaattactcgttcctcttattctctttttatcgataacaattgcctttttagtgcaattaaaacgtaatgcacaaggcgaagatattaaagcattagagtcagctttggttggaaagcctgtgccagaaaaaaatttgacggagttgtttgaaaataaagcttacacgaacgaattgtttcaacaaggtaagccagttttgcttaacgtatgggcgacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggcgtgattcattatcgttatgctggagatgtaaacgaaaaagtttggactcagactttaaaaccaatttatgacaaactttcggagcaacaataatgaaaaaaacatggttatttttgaccgcatttttgtttagctcagtggcgttttcagctattgacgcattaaattttagttctccacagcaagagagtgattaccaccaattaacacaatctttgcgttgtcctcaatgtcaaaataacaatattgcggattccaatgcgactatcgctgtggatatgcgtggcaaagtatttgagcttttacaagaaggcaaatcgaaaaatgacgtagtggattatatggtggcacgttacggcaattttgtaacctatgatcctcctataacagcgagtacattagtgctatggattgcgccattattgcttgtgttgttaggcgtggtgtttttattaagacgcaaacctaaaacccaaagtgcggtgaaatcccaagaggttttaacggatgaagataatgcgcgtttggcagaattattaaacaaggataaatagatgaattttacattaatttttatcttaaccactttagttgtggcgttaatttgtttttatcctttattacgtcaatttaaagcgaaacatgggcaaaaacgtgatgatttaaataaggcgttatatttctcacgcttggaagaaattgagcaagataattcccaaggtttagttgaaaatgttgagcaactcaaacaagaattacagaaaaccttgcttgatgatgtaccgagcaaggttcaagagaatgtggattattctggcaaatcttatggaaaaatttggtttgtctctggtgtattagcgttaggaattatcgcaggttcttcttattttatggtgggatcttggcaagccgaatcaatgttagagcaaacttatgcgaaattgccctatttctttgaccgaatgaaagatgaagataaaaatccattttctgatgcagaaatgcagcaattttctaccgcacttcgaatcgatttgcaaaaaaatccaactgatgctaaaaaatggtggatgctcggtcaaattgggatgaatttaggtgatgcacgtttggcattcgatagctatcaaaaggctaataaacttgaaccagataatgtgcaatataaattaggctatgctcgtatattgatgttttctgaagatgcgactgataaacttaaaggtggcaatttattgcgtgaagtgattcgtcaagaacacactaacattgaagcattgagtttactcgcattccgttattttgaaacagaagattataaaatggcggcagtgacttgggcgatgatgctacgcttaatgccgaaagatgatgagcgagttccattaattgaaaaaagtattcgtaccgcgcgtgatgctttagaagcgcaaaatgaagaaaaatcaaaaagtatcactcccgaaaaataacctagtacgttataagactttttgatatagtgcgaaaaaattattcgtagtcgaacagattagcatttaataaagtactaaaggaacgagaaatgaataataaaaattgcacttttttctttgttctgcgtcattattggaagtttatttacttcacaattttcgattgcagaaaatgattctagtgcagttgattctgaagataaaaaagcatttaattccgatgtttcaaataatgatgctcaaaaactagctcaaagtattgaatttaaagtttataaaatagatgaaaccacttcatcagaaagtatttatgaatctccagctggaatttgtcagggatttaagattacaagaggtgtagattacacaaattcgacttaccattatctttatccagacaatagaggagaattctatggcagtgtggttggtgcaaccatttataaccaaaaagatcctcaaaatttaagttatgtgcctgtttattcaattacagacaaagatttgtctaagtgtattcaggcacaagaaaataaaaaattaaaggaaaaagcagcgaattatgtatcagaaggtagggctgtattaactgacgtaatttgtaaataggatgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgttcttccagttacaccaagcgtcgggtatcattataattatcactattttagataaaaaattatcttgttatctgtgctaaaaattcttcttctgttaatactgtaatatttagttcttgagcttttgcaagtttagagcctgccccatcacctgcgataacgaaatctgttttactggataccgaaccacttacttttgcaccaagctgttgtaataaggcttttgcttcattacgccccatttgtgtaagagtgcctgtcagtactacagttttatctttgaacaagttttcactcgcttctttcacttctacagtttcccaatgcacaccttgtgcgattaaatcctccacgactgcaacattatgcgcttcacgccaaaatataaaaattcggttcgctacaacttcccctacatcaggcacttgttgaagttcttcaagatttgcgtctttaagcgcatctaaagttttgaaatgattagcaagatttaatgcagtggcttcgcccacttcacgaatgcctaaagcaaaaataaagcgatcaagcgtcgtgctttttgcattttcaagactattgagtgcgttttctgcagattttgcacccattctttctaagcgtgtgagcgtggttaaatcaagtttaaataagtccgcaggtgtatgaattagctctcgatcgactaattgctctattaattttccgcctacaccatcaatatccattgctttacgagagacgaaatgttttaacgcctctttacgctgtgccgcacagaataatcctcccgtgcaacgtgctactgcttcgccttcaatacgaataatttgagaatcgcacacagggcaatttgttgggaaaatgattggtttagcattatcagggcgacgttcgtgtaatacgccaataatttgtggaattacatcgcctgctcgacgaataacaacagtatcgccaatagcgatatttaaacgttcaatttcatcgccattatgtaaggtggcattacttactgtaacgcctgcaacaaacactggctctaatttggcaactggtgtgattgcgccagttcgacccacttggaattcaacatcattcaacagggttaattcttcttgggcggggaatttataagcaatcgcccagcgaggtgctttagaaataaatcctagttcattttgtaaggctatatcattgatttttaataccgttccgtcaatatcataacctaacgagctacgtttgttttgaatatctcgataaaaacctaaaacttcatctgcaccattgcataaacgaatttcaggatttactggaatcccgatagattttagccattgcaaacgatcataatgcgtagtcggcagatcaatcccctcagcaattccaataccataagcatttaataccagcggacgtttgctggtaatattaggatcaagctggcgtaaagagcctgccgctgcattgcgaggattagcaaaggttttttcattatgttctaacgcatatttatttaaacgctcaaagcctgcgtgcggcataaaaacttcgccccgcacttctaaacgtgctggaggattatctgttaaaagttgtaatggaacattacgaatcgtgcggatattggctgtaatatcttcgcctgtggtgccatcaccacgagtggcggcttgtgtaagttcaccattaacatacaaaatactcacagccaagccatcaagtttaggttcgcaacagaaagtaagtggtttcggtaataggattaaacgatcttcaatgcgttttacaaaagcattaaattctgcatcggaaaaagcattatccaaagagagcataggaatttcgtgacgaatttggctaaacccagaaagtggttttgcaccaacacgttgagtgggcgaatctgacgtcagaaattcaggatgctctaattctagggctttgagctgatgaaataaacgatcgtattcgctatcaggcacgctcggattatctaaaacgtggtattcgtattcatattggcgcaaggttttgcgtagattgtctagttgagtttgaatatttgtcataaaattctcggagaaaaatgaccgcacttttctatgtatttagcgtgaaaatagacaggtacaaagcctgtctaaatgaatataaaagtgcggtaaatttaaggtatgaatttacactcgagcaagataggcttgctctgcatttgcatcaaaaatttcttgttcttcagtcagtataacaccttgtaaatcttcggctaatgtatgggcagcacgcatcatcatacgtaaattagcaagattattacctggagagggcaattgcataaataatacaattcctatggtgttaaattccgctaagttataagcattgaatgtgccgggttgttctaaatttgccacactaaaaagcacgggacttgccacacttaaatctaagtgacgatgatacatttcatctttacccaagataaaacccaagttttcaagagcctgcaccaatttagcaccattaaattcttcgctagattttggaataagataaagttgaatatagccagttgtttgttttggctgagctgtcgtttctgcttttggttcattgaacgagaggttgtagtctacttgatgttcttcgtgagataattctgcaagctgcactcttaattctggcgatgatgaattaatgccattaaaaccaacattttgactttgtgcttcaagttgttctaaggtcatacttgcgacattatttgcggttggcatatcgtattgaggttgcgttggttgtattggctcggaacgatgattccccatatcataaataggttgcgtgttaggaatagaaattttgatgtcatccacacttttatcgctttggcgataatcgatcaattcagcttctgatggtaatttttctgtggtcggttgagaaattggtgtatgcccattttccacataggtattcggcgaaatattgtttggctgtaccatttcttcttgcgtatgggatctagatgttggagaagtgcggtcaaatttattggctttatcaaaatattttgatttctcacgacgatttgaccataatccgtgtacgattaaggcgacaagtgctacgatacccacaataatcaaaattgtatttaaatccatttttattccttacgcgcgatagttcggcgagagtactataaatggtgctaatgctaccatatttcagtaggtgaaaaaatacttcaaagtgtggaattttaaaggaaaagtgcggtctgttttaagcatatttttattgaaaggaaagaaaaatgttaaatcttaatgaattaaaatctggtttccactattttgtgatgggctggcatttcatcacacaaaaaggtttgcgtcggtttgttattattccaattttgctcaataccattttgctttgtggtttattttggctttttattagccaaatcagcagtgctattgattgggtgatgaattttattccagattggcttagttttctcagtgtcattttactgacactttcgattttaacgattttattgctcttttattttacttttaccacgttttctggctttatcgcagccccctttaatggtttgttggcggaaaaagtagaaaaaatgctgacggaggaaaatattaatgatgatagtctcgtggatataatgagggatgtgcctcgtatgcttgctcgagagtggcaaaaattacgttatagcctacccaaaattatcgccttatttttactgagttttattcctctggttgggcaaaccatcgtgccagtacttactttcttgttcacttgttggatgatggcaattcaatattgtgattatccttttgataatcacaaagtctcttttgatatcatgaaaactgcacttggcaatcaacgaactcaaagtttaacttttggtggattggttacttgttgcacatttgtgccagtgattaatttattaattatgcctgttgcagtatgtggtgcgacgctgatgtgggtggaaaattatcgtaatgacttaggttttaatatgaatagatctttttcctctcaaacggggcttgatgttcgttcagaaaatacagggattgttaaatagcctacagttataaatagatcaaataactatttttttaatcaaaagtgcggtactataaataaaccaacattaacgaagtccaacgaaagggaaatattatgacaatttatgcagacaattcttattctatcggaaatacgccgcttgtgcgtttaaaacactttggccataacggcaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggtgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggtatttctcgcgcgattaaattagattttggtaaacaaatcacttctgttgccgttgagccagtggaatctccggtcattagtcaaactttagcgggtgaagaagtaaaaccaggtccacacaaaattcaaggtatcggtgcgggtttcattcccaaaaatttagatttatctattattgatcgcgtagaaactgttgatagtgataccgcacttgccacagctcgtcgcttaatggcggaagaaggcattcttgcaggtatttcatctggtgcagctgtcgcggctgcagatcgcttagctaaattaccagaatttgccgataaactcattgttgttattttgccttcagcttctgaacgctacttaagcacagcactgtttgaagggattgagggataaacaaaaaagaataaagtgcggtgaatttttaccgcacttttattaagactagagtagttcaatctgaatgacatcagattgtttaatccccttattttatcctttccttcttattcaaaatcaattttttcttcttttcatattctgttcattgaatttttttattaatgcagtaaactagccaccgatttttaatcatctttcttttcactttaaatgttacccgcgagtaacaaaaggacacatcatgacaaacaaagtaaacagttatggctggaaagccttaattggctctgccgtaggctatgcaatggacggtttcgatcttctcattttaggtttcatgcttagtgcaatttccgcagacttaaatctaacacccgcccaaggtggatctctcgtaacttggactctgattggtgccgtatttggcggcattttatttggtgcattaagcgataaatacggtcgtgtacgcgtactgacttggactattcttctttttgcggtgtttactggtttatgtgcgattgcacaaggttattgggatttactgatttatcgcacaattgctggtattggcttaggcggtgaatttggaattgggatggctctagcagcagaagcatggcctgcacgccaccgagcgaaagcagcatcttatgttgcattgggttggcaagttggtgtgttaggtgctgcgttgcttacaccattattgctcccgcatattggctggcgtggaatgttcttagtgggtatcttccctgcatttgtcgcttggttcttacgttctcatctgcacgaacctgaaattttcactaaaaaacaaaccgcactttcaacgcaatccagctttactgataaattacgttcattccagcttctgattaaagacaaagccacgagcaaaattagtcttggtatcgtcgtactcacttcctgtacaaaacttcggttattacggcattatgatttggttacctaatttcttatcaaaacaacttggattcagtttaactaaatctgggctttggaccgccgttaccgtctgcggcatgatggctggcatttggattttcggacaactcgccgaccgaatcggacgcaaaccaagtttcttacttttccaattaggcgcagtgataagtatcgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggcgcagttgtacttgcttactctttccaaacggccatcgctctacttgcgattatctacgtaattgatatgttagcgacaattttcttaatccctgaattaaaaggtaaagccttagactaagaaaatataaaagataaaaatgctcgccaagtgcgagcattttttatgaaacaagtcatcttataagtaatatctttataagttttcttttcactaagcaaactttcattattttgctaacagttcgttcagtttttctaatgccatttctggcgtaatatcaatcaaactttgatgataccccccctctttgtcgcctttacggactttaatcaatccaccttcaattaaacgaataatcgttgctttatctgaaagcggcggcgtatattgtgggctagttggtccataaagtgcaatcaatggacgatttactgctgccgcaatatgcattaaaccactgtcattggtcacgaccgccgtacaatttgcaattaaatccactgcttcatttaagttggtttttcctgctaaattgacacaaaactcacgcaacgcttctggcagtgcttgacgaatttcttctcccactggttcatctttagctgaaccaaatagcgccacagcatagccttgggtaattaacatttctgctaattttgcataatgataatgtggccaacgttttgccgggccaaattccgcaccaggacaaaaaccaataattggacgctcgcctaaaagtgcggtttgttttttaaagttttttaaggtttcagcttgttgagtgggatcaacggttaaataaggttttagaacaggaatatcagccgctttcggtaccgcattttgctcaaaagctaacgcgacataacgttgcaccatcataggataatcacgtttattattgcgtaaatcgttaagcaagaaataacggctttcccctttccagccacgacgcaccgcaatttttgcaaaagcgggaataaaagctgacttcaaggagtttggtaatacgatcgccatatcatattgattgcgcaatgccttacctaaacgataacgcgttcccaattcaaaggctccgtgccctaatggcatttcaatcgccttacgcacttctggcatacgcgcaagcaaaggcttacaccaattcggtgccatcacatcaatattgcagtttggatattgaattttcagttgctggtacaaactgtgcgacatcatcatatcgccaacccaagatgggccaataattagaatattcattttctgtctttcagataaaagtgcggtcaaaaatacttgttattatggcacagagttgaataaaaatatgctcctttaacaatttagtcgaaactctttaggagtcatttcaaattctttcttaaaaacagagtaaaaatattgaattgatggatagccgcaaatctcagcaatttcttgaatagaaatatctgtttgttgtaataaattctttgctcgggaaattttttcttcgtggatgacttggtgaattgttttattcatttcattcttaaaacgttgttcaagattagaacgtgaggtttcaagatgatctaaaacttgttctactttaattcgatgacaggcacgatgacgaatataatgcattgcttgaatgacaagcggatctgttaatgatcgataatctgtagaatttcgagagtgaacggtaatcggtggaattaaaataggggtatgtgaaactttttgaccattgagtaatttgtgtaataatttcgcagcttgataaccaatctctctcgtgccttgttctacggaggaaagggacatacgcgataaatattggatcaattcttcattatcaataccaaccacacaaagctcttcaggtacagcaattttactgtattcacaagcctgcaataaatgacgagcacgcgcatccgtaacagcaataataccagtatgagaaggaagagattttaaccagacaattagcttttgttgctcttccaaccaattttgagcatgaacctgcacaccctcatataggtaaatagggtaatgatttttctccatcaactctacaaaagcatctcttcgttctatagaccaatgcttatgagtatttacttgcaaaccataaaatgcaaactgtgacagtcctttctcctgtaaatgagataaagccatttcaaccaatgccatattatctgttgctacataaggaaagtgcggataaaaatcagcttgtttataagatccaccaactgctatagtaggaataagagtgtgttgcaataattcaacagtttttggatcatcaaagtctgcaataatgccatcaatagaaagttgattaatagtatcagtatgatagataaattcatcttctacaaaaatatcccacatacattgcgatgcctgaatatattgtccaataccctccaccacctgccgatcatatactttgtttgcattaaataagagggcaattttgtagtattgttccgtcattttatatccttatctatgggaaattgctatttaagttataatagaaaagatatttagcttcaagataaaaatagccagaataactggccatttttatatccaataccacatttatttttttagcttcgcaatacctattccacttgcaccataaataatagcaaagataataccgctccaacataaaattgcccaaggtaaataagacaatgttgcaacacctaatgtgcctgccatatatgcacctgcggcagtccatggcaaaataggttcaataattgttgcggagtcttctgctgttcgacttagattttttggatgtaatcctttttctacatacgcatttttaagcatttctcctggaattagaatagaaatttgcccattacaagtaaccccaatcattgttagaccgcaaagaatcgttgtaataatcaaagaaagagttgaatgaacaaaggtgagtaatttttgaataatcacggttaatgcaccgctcaattgtaatacacctgcaaatgataatgcacagaaacaaattaatagtgttcccatcattgagttcattccaccacgattcaacaaacgacttaaatcagagctaactgaagtatggtgaatcattgaggtatcaaatccattaactgcgctattaatcacatcagatagagagaatttttgaattaagatagcattaataattgcgataaatgctgataataacatcactggaatagtcggtttcttagtaatagatccccataatacaatagcgactggaataagtaatagaaagttaaaatgataaacttgctctaactcatgaatcattgtatttactttttctggagtcgctacattagaaaaatcgtagtttaaaccatataccacatagacagtagccgaaagaataaaagatggtaatgttgtataaagtaagtgaactatatgctcatataaatctacgccagcagctgcggatgcaatattggttgtatcagataatggcgataatttatctccaaaatacgcaccagcgaccacagcacctgccgtagcagccaaattggcgtctaatccaatcgcaactcccataaatgccacaccgacagtccctgctgacccccaagaggttccagtacaaatggaaacaatagcagtaaggaataaggctgtcacataaagatattctggtgatattgcttttagtccgtagtagatcatcataggaattgttcctccactaatccaagttccaattaataatcctacagtaattaaaattaatagcgcaggcattgttttagctattttttctgaaatggcgtctaaaatatctaaatagcaatgacctaatttaataactaaaaaaccagcaaataccgttgaaataatcattaatggctctgctggcaaatcaaataaagcatacccaagccctaacagtaatagcatcacaatgattggtgaaaaagcttctaatgttgttggcattcttgtgcgatgagtggttttcatattaaatctccctattgtttaataaacaaaacccatttttgattcgattcaatgcttctaataatttttttctaggcatagcgacattcatacgaaagaaaccatctccctctttgccaaattcactccccaaagatacttttactcttgataaattattaatccaataagctaattcattttcatttatacttagctttttatagtttatccaaagtaaataagttccatcactttcagtaatatctaataatggaatatactcattgaaaaattcttttactatcttcttattattctttatgtattcttttagatagattacccaatcagtacaatatttatataacgaaataatagctggtatagagaaataatttggattatgtatacctaatgccatcatttcttttataaatttttctcgaatttctttattctcaataattaggttagctatttccaatccaggaatattaaaagtttttgctggggataaacagatcattgagtgatttgctacccattcatctaatgatgatattaaatagtgggagtcatttgttagtgtaaagtctgcgtggacatcatcggaaatgataaatacattatgttttttagctaagtttataattttaataaggacttctttattccaaatcgttccagttggattatgaggagaaattaaaacaaatactttagaatgtttaaaacattcctctaataaatgaaaatcaatatgatactttctattttcataaaccaaaggacattgatataattttctgtcatttaattttatcgtgtttaatattggactatatgaaggtgatagaatacatattccatcattttcttttgtaaatgctcgtatataaatagatacggcttggattattcttgggcaaaatacaattttttcagagagaacagaataatgatattgttcgaaaatataatcactgattatcttgtaatagtcggctggtaattcagtataaccataaattcctaaacgattaaatttttctaattcatctatcattatctgaggggctggaatatccatatccgcaacagacattggaataatatcattatctacattccatttagcactaaatgtatttagacgatcaataatcacatcaaaattataaaaattattcattattcctcctgatgtataaggcaaatttactttagtcaaagaagaaaagaattaaaattactaaaactactttatctattacgttttttcacaactgtgatccacgccacagttgcaaataatcaacatagaaaaattaaataacataattgatgaaaagttagtttttcacaaaaatgcgaaaaatttcatcacctagagaggaaaatgttatgacaacctatttcgataaaattgaaaaaatctcctttgagggagaaaaatccacaaatccttttgctttcaaacattatgatgctaatcaagtaattttaggtaaaactatggctgaacatttacgcttggcggtgtgttattggcataccttttgctggaatgggaatgatatgtttgggctaggttctttggagcgaagttggcagaaaaatccaaatgtgcttgctggcgcagaacaaaaagccgatattgcttttgagtttttgaataagttaggcgtgccttattattgttttcatgatgttgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgaggggtatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaatacgttagttatgtatgaaattttaaaacatggcggttttactactggaggctttaattttgatgcgaaaattcgccgacaaagtattgatccttatgatttattttacgctcatatcggtgcaattgatgtattggcattatccttaaaacgtgcagcaaaaatgttacaagagaaaaccttacaaaaaattgttaatgcacgctatgcaggttggaatagtgaacttggtcagcatattttgcaaggtaaaacttcacttgaaacacttgcgcaacttgtccaacaaaaagatttagcaccaaaaccagtttcaggtcagcaagaatatttggaaaatttggtaaaccaagttatttatagctaaaaatgaagcaaaagtgcggttgtatttcaccgcacttttttattttaggagacattatgtatataggaattgattgtggcacacaaggaacaaaggcaatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgcaccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattgcttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatgcaaaagcgagcattttaggattagattcaagtaatttcacacgagaaaatctttgtcgagcaatgatggaaagtgctacttttacgcttcgctatggcttagatttatttcgtcaagctggcctcgaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaagtgcttatgagcgttatttaatacatttatcacaattatattaaataaaatcccctatgccgataagctataggggatttactacattaataatttattttctattcaaccacgccatatattcagtcacgccttccgcgactgttttgaatggtttatcgtagcctgttgagcgaagtttagttaaatctgcttgagtatattcttgataacgagatttcaaatgctctgggaatggaatggtttcaatctcgccttttccgtggaatttcactaccgcatcagccaccgcacggaaactttctgcatttcctgtaccaaggttgtaaatacccgaaataccattttgccaacaccaaatattcactgcagccacatcgcctacataaacaaaatcacggcggaatccttcgctgcctgcaaataattttggattttcgccttttaagatttggttattcaagtggaatgccacactcgccattgaacctttatgattttcacgcggcccgtaaacattgaaataacggaaaccacatactggcgattttgcttctggcaaaatgttacgcacatattgatcgaacaagaatttagaatagccatacacatttaatgggccttcaaattcacgttcttcacggaatactttggtgtctccataagttgctgcgcttgaggcatagaaaaaaggaatttcacggtcaaggcaataatgcaacaactctttagaatattcgtagttgttgtgcataatgtatttaccatcccattccgtagtcgcagaacatgccccctcgtggaataccgcatcaatatcgccaaattcatcgcccgcaataatagaagcaatgaaatcttctttatcgcaataatctgcgatgtctaaatcaactaaatttgcaaatttcgtgccatcttttaagttatccaccactaaaatatctttgcgccctaaatcattcaatgctttgacaatattactgccaataaaaccagcgccgcctgttacaataatcataattctgtcctctttaaaataagtttgcgtattgtaatagattttctaccgcttagccaaaaaactctgcgaaaaacaaccgcacttttaatccccaataactcgtaaggcctgtcgtaacaagatccattttgcctttactcaacaacacaattgtgggtgtcacattaatttgccatcgttctgcaaattcccctttaggatcattaaccgtagtgaagtggtagtcatgcttacttaaataatcatttacgtccgcctcattgcctgagcgtaatgccaccgatacaacttgatagccttcgtttgctaaagaattaattgctggcgaagtataacgacaataaccacaccaagttccccaaaaataaagtaatgtgggtttgttttgatcaagactatcaagagagaacgtactcccttgaagatcttgtaacgtgattttatttatttcctttggcactacagggcgacgaacaaaatccagtatgctagttatcacaataaaagttaaaaagagggataatccattcttgagtaattttttaatcttcattttatttattccttatcttgttgagatgattgtaattgagcgtacaaccatagtcaaaaataaagaatttttgctacaataggtaaaacataaataaaaggaggaaaataatgacatcaaatcaacttgctcaatatatcgaccacaccgcacttaccgcagaaaaaaatgaacaagatatttcgacactctgtaatgaagcgattgaacatggattttattctgtatgtatcaattctggttatattccactcgctaaagaaaaacttgctggctcaaatgtaaaaatttgtaccgtagttggcttccctttgggggcgaatttaacctctgtcaaagcatttgaaacgcaagaagctattaaagcgggtgcaaatgagattgatatggtaattaatgtaggttggataaaatcgcaaaaatgggatgcagtaaaacaagatattcaagctgtatttaatgcttgtaatggcacgccattaaaagtaattttagaaacttgtttgctcactaaagatgaaatagtgaaagcctgcgaaatttgtaaagaaatcggtgtagcttttgttaaaacatcaacgggtttcaataaaggcggcgcaactgtagaagatgttgcattgatgaaacaaacggtcggcaatattggtgttaaagcatcaggtggtgtgcgtgatactgaaactgcacttgcaatgattaaggcgggtgcgactcgcattggtgcaagcgctggcattgcaattattagcggtacgcaagacactcaaagcacttactaatcctttcacgcgtggtattctttccacgcgtttttacatattcgacaatttctgcagcaaacgatccattgctcgatagcccaaggcctccgccaagtgcggttgagaaatttgttgttctccttgtagatcggcaatggttcgagaaactttcaaaatacgatgataagcccgtacagaaagcccaagtttattcagtgctttttcaaggaaaaaggcatctttatcatttaacttgcaatcacgctcaatctctttactgttcaaataagcgttgattttccccgctctttccatttgaatctcacgtacttttaacactttttcacgaacttgcacgctggtttcgccacgatcgcccgtattttgcaagctaccttgtggcagtaaaggcacttcaatagataaatcaaaacgatctaaaaatggccctgaaagtcgattcaaataacgcataatttgctgtggtgaagtgcggttatgtgtcccagtataatggcctgtagggcttggattcatcgctgccactaattgaaaacgagctgggaattgaatttttgcattggcacgagaaataataatctcaccactttccaaaggctggcgtagtgcatctaacacttttcgctcaaattctggaagttcatcaagaaaaagcgccccatttgttgctaaggatatttcgccaggtttagggatcgttccgccaccaactaaagccggcattgatgcactatggtgtggtgcgcgaaaaggacgttgcttccaattatgaaaatttaactcgttttgaactaaactcgttacagatgctgtttctatcgcttctaaatctgtcatttcaggtaaaatccctgtcaaacggctggctaacatggttttccctgtacccggtgggccaagaaagagcaaattatgctgccccgctgcggcaatggtcaatgctcgtttagcgtgctgttgtccgataatatccgttaaatctaacgtatttttacctgaaaaatttaccgcactttctttcacaatttcagtggcgaggggtaatttttcctgaccattgagaaattgcactacatctaaaagcgtttgagcaaaataagtattttgatcagacacgagcgaggcttcattagcattttgtttcgcgataattaactctcgctttgacttttgcgctgcaagaatagcgggaatcacaccatgtacgccacgcaattggcccgtcagcgcaagctctgccacaaattcaaattgctttaaacggcttgcatcaagctgatctgatgcagctaaaatcccgatagcaataggcaaatcaaatcttccgccttctttcggtaaatccgcaggggcgagattcactgtgatacgcttggctgggtatttaaattgtgcattcatcaacgcactacgcacccgatcttgtgcctctttcacggttttttctggcaaaccaacaagtgtaaatcctggttttccgttgcttaaatgcacctcaatggtgactagcggtgcttgcacacccatagaagcacggctgtaaacaatagcaagggacatgataatccttaaagtgcggtaaaaatgaagatagtttttgcactataaaaaaagcacgtaatgaaatcattcattccgtgctttttttgcgatctagatcgcaaaattcatattttatttcgcaaaaagtggcgaaaaccaaaaatctaatttcgccgccaatttatcaataccaattttattttgtgcagaaaaagcctcaacttgtatatcgccttgaaatggaagaattgcttcacgcaccatttttacttgtttactacgtgcgctttggctcaatttatcggctttagtaagcaataaaagtaccggtaaatttgctgaaaccgcccattcaatcatttgttggtcaagatctttaagagggtgacgaatatccatcaacacaaccaatcctgccaaacattcgcgtttttgcaaatattcgcccaaggatttttgccattggattttcatttgctctggcacggcggcatagccatagcccggtaaatctaccaatttacaatttggttccacttcaaataagttaatcaattgcgtgcgccccggtgtttttgaggtgcgcgctaaatttttttgattggttagtgcattaagtgcggtcgattttcccgcatttgaacgacccgcaaacgcaatttcaatgcccgtatcttcaggaatggaacgaatattcggcgcgctcgttaaaaagtgggttttgtggtaattaagtttaatttcagacataagtattccttttaaaaattgtgtttagaatagcataaatggaaaatttcctgaaattatgtcaaaattctctctgaaattataatcaattaatggcaatccagatgacaacaaaaacaacttaccaatggcctcaatctaaggatatttatccatatcgaccagggcgttttgatgcaccaaaacattggcgttataacttacgtagctttttaaatcgtggttcaattcgtcgctttgaacaatttatcaatcaatatccttttctcgtcgatatttttaatacgcacttggattatagttatcctgttgcttgtcgttttttagataagcgttttaacgcatcacaacgttttcatgccgtttgtgagaatcttttatttttacccgaaaaacttaccgcactttctacgccgttatgggaaaaacctctaagttttggcgaagtcattcctgattttgaaatgacattaagcatgacaacccatcaaccgatggaaggatattgggtattggagctatggcataaaccaagaaacgaattagtctatttgcttacctttgccaaattaggcgatgcgttgcttattgctgttgtacaagggccaaattttgaaggctcaaaggaaatggtgaaacaactaaccaaattatgccacggtttacgccctgcctatttaatggttgaaaccatgaaatcactcacaaaaatactaggctacgataaattgcttggcattccgcaaaaataccaaaataaatctcgcttcattcaaagtaaacaatatactgtggattatgatgcaatttttggcgaatcaggcggagaattaaaagattactgggaattgcctttagaaatggatagaaatctggatgatattccaagtaaaaaacgttccatgtatcgtaaacgttatgcgatgctagatgatttggctaaggtaattgaagaaaagttaggattgtaaaagtaaaaagtgcggtgaattttaaccgcactttttgttttataagactttcaagcaagccacaaaatggctgttgttttggctggtgaaaggtggtttttgtttcgcacaattctcatcagcctttagacagcgagtacgaaatacgcaaccagacggtggattaattggcgaaggcaaatcaccttcaagtaattcgatggatttattgcgttccaattttggatcggggatcggaacagcagacattaaggctttggtataaggatgtttggtatcgttatatacttccacatcgctgcctaattccattgcattgcctaaatacatcactaatacgcggtcagaaatatgttttaccaccgctaaatcatgggcgataaaaattaaggaaagccccatttctttttgcagggatttcaataaattcaccacttgagcctgaatcgacacatctaacgctgaaacgggctcatcacaaatgatcattttgggctcaatgattaacgcacgagcaataccgatacgctgacattgaccaccagaaaattcatgtgggtagcggttaatcaagttcggtaaaagcccaactttcaacatcatagcttgcactttttctttcacttcggcggcacttaagtgcggttggtagatctttaatggctcagcaatgatttcgccaatattcattcgcggattgagagaggcgagcggatcttggaaaatcatttgaatatctttacgcgtttctttccattgtttcgctgattgttttcgtaaatgtttaccaagccacaagatttccccttcactcgcttcgactaaaccgataatagcgcgtgcaagtgtggatttaccacaaccagattcacctactacgccgagagtttcacctgcgtaaagtttaaaagacacatccttcaccgcttttaaggtttgcggtttggcgaagaaaagggatttatcatttttaattttaaaactgacgcctaagtgattgacttcaaggagtaattctttgttgtttgagactgtcataggttaaatttctccgctgataaccaacaattacgtaattgaccgtgattaaatgtagtcagttttggcgcaatttggcattgttcggtagcaaattggcaacgaggtgagaatggacaaccttttggcaaatgcaataaattcggtggattgccaggaatggtgaccaagtgttcttcattgccgtctaagcgaggaatcgcatccattaagcctatggaatagggatgggttggatgatagaaaatttgttccgctgtgccgtattccatggttcgtccagcatacatcaccatgacttgatcgcagataccagccactaccccaagatcatgggtaatcataataatcgcagtattaaattcgtgttttaactcatttaacaaggtcatgatttgtgcttgaacggtcacatccaaagcggttgttggttcatctgcaatgagtagtttgggacggcataatagggccatcgcaatcatcacccgttgacgcataccgccagaaaactcgtgcggatacatgcccatgcgttttttagcttctggcattttaactgcgtctaacattttcacggattcggcaaaggcagtttgtttatcatagcccttgtgcaattgcagcacttccatgagttgttcaccgattttcatgtatgggttgagtgacgtcattggatcttggaaaatcatggaaatttgctcggcgcggattttattcaattcagcattcggtaaattaactaattctttcccttcaaaaatggcagagccttccacttcaccgttggctgccaataaacccattaaagcaaaggctgtttgtgacttgcctgatccactttcgcctacaatgcccagcgtgcttcctgcattcagcgtgaagtttaagtcattcactgctgtaacgacgccatctggtgttttgaagcgaacgtagagattttttacatctaataaaggattcattattcgctcctatctatctttcggatcgagcgcatcacgcaacccgtcaccgataaagttaaaacaaaatagggtaaggcaaaggaaaaatgccgggaaaattaataaccaaggcgacacttccatttgtgcagcaccatcacttaagagtgcgccccaactactcatcggctcttgtgtacctaatcctaagaagcttaagaatgattcaaatagaatgagcccaggcacttcaagcgaggcataaactgccactaagcctaatacattcggaataatgtgtttcaaaatgatttggcgacgaggtacgccacaaacgatggcggcttcgacgaattctttattttttaggctgagggtttgtccgcgtacaatacgtgcaagaccaagccaggcaatggccccgatagcgataaaaattaagaaaatgttttggccaaaaagggtcaccaacaaaatcacgaaaaacataaatggaaatgagctaagaatttccaaaaagcgcatcatcagcatatctgttttaccgcctacataaccggaaatagccccataaattgtgccgatagtcacggaaatgaaagcaccagcaataccgaccaataatgaaatacgtccaccgatagcagtacgtaccaacaagtctcgacctgaggcatcggtaccgaagaagtgatagccttccattgttggtgcggagctcatcatattccaatcggtatcttcataggtaaatgggaagaaccaaggcgctacggtgataaatataataataaacgccaaaataatcagactgacaacggccgctttgttgcggaaaaaacggcgtttcgcatcttgccataggctgcggccttccagttgcatttcttcaatacggtcagccacttgttccacaaaatccgcatttttctgattaatcggctgagtacgataatctgtcataacttatccttaataacgaatttttggatcgatgatggcgtataaaatatccacaatcgcattaaataaaatggttaatgcccccactaaaatggtgaggctcaaaactaaagagtaatcgcggttcaatgcgccgtttacaaataataaccccatgccaggtaaaccaaatacgctttcgatgaccattgagccagtaataatccctacgaaagcaggtcctaaataggttatcacgggtaaaagtgcgggacgcaaagcatgttttaaaatgattctcgacatggaaagtcctttagctttggcggttcgaataaagttggaatgtaacacttcaatcatcgaaccacgcatgatacgcgcaatccctgcaacataagcgatagttaaggaggctacaggtaagatcatgtacatggcggtaccgccgttccaaccgccagctggcagccatcctagataaatggcgaaaattagcactaaaacaggtgcaaatacgaagcttggcataatgaccccaagcatcgagaaactcatcaaaatataatcccaacggctattttgattgagagcggcgagcgtacctgctgttactcctagcacgactgcaaaggcgaaggccaccattcccaattttatggaaacagggaaagctgacgcgattaaatcattgactgattggtctttatatttaaaagagggaccaaaatctcctttggaaagattttctaaataaaggaaatattgtttatataatggttcatttaaatgatacttcgcttcgatattagccatgacttctggcggataagcgcgttcagaagtgaaggggctgccaggggcaagacgcatcaaaaagaaagaaaaagtaatcaaaataaacagcgtcggtaaggcttccaacagccgtttaaaaataaacttgagcataacaactccaaccaaaatgggcgaaaagtgcggtcaaaaaatacgacgatttttaaccgcacttaaatacgagcaacgaattaatgtttaataatataaagattgcgtaagtaaatatgatcttgtggatctttgcctgaataaccttttacgtaaggtttcactaagcgtggattcacatagttaaagattggtacgataccgtaatcttttccaagaatttcttcggctttcgcataagcttttgcacgaccttctgcatcagttgctgcgtaagattctgccatcgctttatcatattctggattcgcatatttcgcggtattgttactagaattagataagaaatagttgccgaatgttgttgcttggttgtaatccgcatgccatccagcacgcgccacatcgtaacgacctgcacgacggctatcaatgtaagttttccactcttggttttctaatttcacatcaatcaaacctttggtgttagctttccacatagaagctgcagcaatagccacttttttgtggttttcattggtattataaagaatgctgaatttcaacggattcgctttactgtaaccagcttcttctaagagtttaatggcttcttcattacgttgtgccatcggttcttttgaataagcaggttgttgaatgagatgaccttcttcgatgtaagttggggtaaacacataggttggtgtttgaccttggcccaatactttatcggtgatcacattacgatcaagggataagttcaaggctttacgaatattcacgttatcaaaaggtgctttcttattgtttaattcataagaataagttcctagggtacgagtaacgtatacttcgcctagcaattctttttttaatttagcgaattgttctggcggtaaaccataactggtcatgtctaaatcgcccgcacgataacgtgctacatcggtacttgggttttcaatggcgaggaatgtcgcactattgattacggtttctttatcgttccaataaagtgggttacgttcaaattcgattttttcgttaatgatgtggttagccagcttatacgcaccgttacccacgtagttttcttttttcacccatgcatcacccaatttttcgactactttttgtggtaatggcaataaggattggtgagtcgttaaactgactgcataaggcacaggattggttgcatgaaccacaaaggtgtaatcatcttttgcttccacgcctaattcagccggttttttcttaccgtcaataatgtcttgcgcattttcaacttgtaaataacttaagtaactcgcataaggtgcagcagttgcaggatccactaaacgacgccacgcaaacacgaaatcgtgtgcagtaacaggatctccgtttgaccatttagcatctttacgtaaatggaatgtccaggttttgaagtcaggtgtattttcccagctttcagccgcacccggttgaagtttaccttcagagtctgaggtgactaagccttcaagtaattgataagcaacgttagattctggcacaccttcggttttgtgtgggtcaaaactttgcggttcagccccgttattgatgacgatatgttgtttttcatctaattgtgttccttcaggcactataactgcttgcacagaataggaaagagcaagagcgattgcagagaagagtagtttgtgttgcatttgaacctccttgttattaggcgatatttttataaaaagtcttctacttattagctcaaaaattcatttttgtaaagatttgtcaggaaattatttgaagaaaaattgagttttgtgagttgtgtctaataaatcgctaaaaaaattgctaaaagtgatgatatgagaggggggaatctaggatgtattgatttttcctattgtaaatattttcctacataaattacccttttaatgctaattgtgctatcgtaacctgattagatttaaacaagtccattcaaggagaatacaatgacaacacagttagattcacttcgtaatatgaccgtcgtcgtagctgatactggcgatattgatgcaatcaaaaaataccaaccacaagatgcaacaacaaacccatctttaattttaagtgcttcagcattaccacaatacgccccattaattgatgaagcggttgcttatgcaaaagctcaaagcaatgataaagcacagcaacttattgatgcagaagataaattagcggtaaatattggtttagaaattttaaaaatcgttccagggcgtatttctactgaagtggatgcgcgtctttcttacaacacacaagcaacggttgaaaaagcgcgtaaattaatcgcactttataatgcagcaggcatctcaaatgatcgtattttgattaaaatcgcttccacatggcaaggtatccgagctgcagaaatccttgaaaaagaaggcattaactgtaacttaaccttattattctctgaagctcaagctcgtgcttgtgcagaagcaggcgtttacttaatttctccatttgtaggtcgtattttagactggtacaaagcaaactccgacaaaaaagaatatgcgccagcagaagatccaggcgttatttctgtcaccaaaatctacaattactacaaagaatatggctacaatacagttgtgatgggcgcaagtttccgtaatgtaggcgaaattactgaacttgcaggttgcgatcgcttaaccattgcaccagcattactgaaagaattacaagaaaattcaaccgcacttatacgcaaactagaatacaaaggcgaagtaaaagcgaaaccacaaccattaacagaagctgagttctactggcaacataacagcgatgctatggctgttgaaaaattagcagagggtattcgtaaatttgctattgaccaagaaaaattggaaaccatgctttcagcaaaactttaatctataattcaatataaaaaataaccgcacttcaatctgctcttgaattagttaaagaaaatatttaactaatttgagtgcagattttttatttattaagatataaaagtgcggtaaaaattcggtgtatttttgtttatttactcctagcggcaatagataatggttacagaaatattattaagtaatacattttcataacaaaatagatgaaatttattataaaaatattttaataaagataaattatatttttaatttatactaaattagtagttagaattttaacttgcgataatcagataaaagtggtagttctcttaagattttatacattccagaatgactaccatttgatatatgattataaattagcttaataaatcacttaatttcttaattaagataatttttctttcctcaaagaattgatcaaaattaccaatagataagttcacatcaggtataaagatggttgtcgaaaaaagaggttatattagattttgcatttttatctaccattcttcaagagaagcatctttttttcgatgtattttcatcaagccattgtaagttataaatagaattataatttttatcagctttttgagttaatagtaactccttaataaatttatcattgatagattaatttaccatccagcttgtgactgcgataaaaatagcaaagatgcaaaaccaaattatgtggagttttgtgcttttacgattgacttcttcattatgtaagcgtcgagcttctaatctttgtttgtacatctctagatctttttgtttgaaagagaagccgcaattagggcaattttctgcattttcactaatcttttttctgcattcagggcatcttgttaaggacatatttgcttttatacctattcaattacttatttattagcattttaatggatgttttagattttacaaatgtgatacaagtcccaaatcttataaaaatctttaaattcaattttgatttgacgtaatttgaaatagaatacagccgcttgtttagggcatataaatacttttactttattttttgaggagccttcctatgttatggtttttcttttgtgtagccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcgcgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttctccatctaaagttgtgtatgatagttcgttacatttcttaggttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagtatgtgcaacttatttgttctacaacaaaattggtttcggcttagattatcagctttctgtgtatcttggtttagcaacaaccatcgtttgtatcgtattgttcttcacaatgcttaaaccattaggtacgcgagatgaagaagcttatataaataattagtcaataaaatttgatgaaaaaagccgtttgaattgtttattcaaacggcttttttattttgataaaaatcagttgctttaatgtggaattacttgcaagttgagcgaacaaattataaacttgccagaagtggagaaaagtggtgttttgtggagatttttagagattttctaaaaataagttcaatttttaaggtgtaatatgtttcgtggtgcaacggcggttaatttagattctaaggggcgtgtagcgatcccaactcgctatcgcgctgaaattcttgaaaagaaccaagggcaaatggtttgtactgtagatattcgccaatcctgtcttttactttatccccttgatgaatgggaaaaaatcgaacaaaaacttctcgcactttctaactttgatcctacccaacgccgtttgcagcgagtaatgcttggccatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcattatagaaaataatgtagtacttttatcttaaatttatgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgtgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatagcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagcaaatcctcgttcaagaagtgccatattacgtgtggcagagagaatttagcgatgtctgaaaataataagcctcgttatccgttacagcagattttagtcgaagatttattttcttcaaataagttagtggtgttgctgttgatagggattttagtttctgcaatgggaacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaataataggtaaaaaagatggtgaaatttaattcctcgcgtaaatcaggtaagtcaaaaaaaacaattagaaaattgaccgcacctgaaactgtaaagcaaaacaagtctcaaaaggtgtttgaaaaatgctttatgcgtggacgttatatgctttctacggttcttattttacttggtctgtgtgctttagtcgcacgagcagcttatgttcaatctattaatgccgatacgttatcaaatgaagcggataagcgttctttgcgtaaagatgaagtattatcggtgcgtggttctattttagatcgtaatggtcagcttttatctgtaagcgtaccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtattgatgaaaaattgcaatctatggtgtatcgtgagattaaaaaggcggtgtctgagaataatgcggagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtcgttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagcgcattaatggaaacttatcaaaatgcaggtttaagtaaaccgacagatttaggcttgatcggagaacaagttgggattttgaatgcaaatcgtaaacgctgggcagatattgagcgtgcaacagtcgcttatggttatggtattactgcgacacctttacaaattgctcgtgcctatgcaacccttggtagtttcggtgtttatcgcccgctttctatcactaaagttgatccgccagttattgggaaacgggttttctctgaaaaaataactaaagatattgtgggaattttagagaaagtagcaattaaaaataaacgcacaatggtggaaggctaccgtgtcggcgtaaaaacaggtacggcacgtaagattgaaaatggacattatgtaaataaatatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgaattgtttatattggcgaacacaagaatcaaaaagtgaattaaggaaaaattatgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatctagcgagcatttaactgtggcgtttatcaggaatgtgccggtagttaaatattatcaacttgcacgtcatctttcgtccttagctgatgttttttatgattcgccctctaaaaatttaacccttgttggcgttacaggaacaaatggcaaaaccactatttctcaattattagcgcaatgggcggaattattggggcatcgtgcggctgtgatgggaaccattggtaatggacttttggggcaaattgtagaagctaaaaatacgacaggttcagcagtagaaattcagtcatctctttcaactttcaaacacgcaggtgcagattttacctctattgaagtttcatcacacggtttggcgcagcatcgtgtagaagccttgcattttaaagcggcaattttcacgaatttaacccgtgatcatctagattatcatcaatctatggaaaattatgctgcggcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaatcgttattgtagattatgcgcatacaccagatgcgttggaaaaagcgttgattgctgcgcgtgaacattgccaaggcgaattatggtgcatctttggttgtggcggagaccgtgatagaggcaaacgtccgttaatggcacaggttgcagagcagtttgctgaaaagattattgtgacaaaagataatccacgaacagaaccacaaagccaaattgaagcagatattgtcgctggctttaaaaatatggaaaaagtggggattattcctgatcgcgcacaggcgatccagtttgcgattgaaagtgcggtagaaaatgacgtgattttaattgctggaaagggtcacgagcattatcaaattattggttcggaagttgtgcatttttccgaccaagaaattgcacttgatttcttaaaataataatcactcaattatgattaaactctctactgtacaacttgcacagattcttcaagctaaattaattggcgatgaaaatgtgcaagttgaagaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaactcgtctattttagttcctcaacttgtggttaaagacactcgtattgctttgggcgagcttgcaaaatggttacgcgagaaaattaatccgcgtactgtggcgatgaccggctcttctggaaaaaccacagtaaaagaaatgacagcaagtattttgcagcataccgcagcagattcagaagcggtactttttaccaatggtaacttcaataacgatataggtgtgcctttaactctgcttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggagttgttcaagcaaaaggcgagatttatcgaggtttaacaaaaaatggtgtggcgattatcaatgctgaacataatcacttagatatttggcaaaaagaaattagtaatcacgccattcaatatttcaacggcaaggactattccgtcaaaaatgttcaaggtaacgaacaaggttcaacctttacgttagtttctccgcaaggcgaaattgatattagtttaccttatcttggagagcataatgtaaaaaatgctttagctgctaccgcactagcgatgaatgttggtgctacgcttgccgatgtcaaagctggattagaacaacgttcacaagtgaaagggcgtttatttcctattcaagtaacgcctaatttattgttattagatgatacttataacgcaaataaagattctctctgtgcggctattgatgtcctaaaaagttatgatgctttccttattctatgtgtcgcagatatgaaagaattgggcgaaaattctctcgctattcatcgtgaagttggacaatatgttaatttggtaaatttagatttggtgtgttcttatggcaatgaaagtgcggttatttctgaggctgttttgggtaagcattttacggataaaactgaaatggtggatttcttagttccacttattgaaaaccaattacaacaaaataaaaaagttgtggtgctgggaaaaggctcacgctcaatgaaaatggaagatgtgatctattcattaaaggataaaattaaatgttagtctggcttgctgaatatcttgttcgttacgaaaccgcctttaatgcgatttcttatattaccgtccgcgcaattcttgcattattaaccgcactttttatctcactttggattggccctaaagtgatcaaacgtttacagatcttaaaatttggtcaagaagtgcgaaatgatggccctgaaagtcactttgcaaaaaaaggcacacccactatgggcggtgtgatgattttattctctattggcgtaagtacgttattatgggcaaatcttgctaattcttatatttgggtttgtttatttgttttatttggatacggcgcaattggttttgtggatgatttccgtaaaattacccgtaaaaatactgatggattgattgcgcgttggaaatatttctggatgtctgtggtggcattagtggcaatcctttggctttattggcttggtcacgacactgatgccacccgtttagtgattccattctttaaagacattatgcctcagttaggtttgttctatattgtgttatcttactttgtgattgttggaaccggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttaggatttttatggtttaatacttatccagctcaagtatttatgggggacgtgggttctctagcattaggtggtgcgctgggtgtcgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgttagtgttgatgggattagtcaccttgaagttgcgttaataaatgttgtgaggttcgctctttcagtttttgaaagagcgagcttttacgttataaattgatattcccatcagcaaaatttaaaacttatagtaattaagaagaaataaaatgaatgcctatcaaaacaaaaatattacgatcattgggcttggcaaaacaggtctttcttgtgtggattatctcttatcccaacaggctaatattcgtgtgattgatacccgaaaaaagcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggaaaaagtactgttactactttagtttatgaaatggcgaaagctgctggcgtgaaagttggtatgggcggaaatattgggattcccgctttgtcattgttgaatgaagattgtgaactttatgtactagagctttctagttttcagcttgagacaacttatagcttaaaagctgcggctgcgactgttttgaacgtgactgaagatcatatggatcgctatatggatttagaagattatcgccaagcaaaattacgcatttatcataatgctgaggtcggagttttgaataatgaggataagctgacttttggtgaaggtgaaaatcaagcgagacaaaccgtttcttttgcggaaaatagtgcggattattggctaaaaactgaaaatggcaagcaatacttaatggtaaaagatgaagtaattttgccttgtgaagaagtaacattagtcggtcgccataattatatgaacattttggcagcaacagcattggcacaagctgtcggtattaatttagattcaattcgtaccgcacttcgtcatttcaaagggttagatcatcgttttcaattagtgcatcaagctaatggtattcgttggattaatgactctaaagcaacaaatgtggggagtacagttgctgcattagctgggctttatattgagggtaaattgcatttgttgctaggcggagacggaaaaggggctgatttttcagaattagctgaattaattaatcaaccacacattatttgttattgttttggtcgagatggtgtgcagcttgcaaaattttcatcacaaagctatttgtttgaaacaatggaacaagcgatagaatttttacgcccaacattgcaaagcggagatatggtattattgtcgcctgcttgtgcaagtctcgatcagtttgcttcttttgaaaagcgcggcgaagaatttacgcatttagcgcaatattcagcctaatttagtcattaataaaaataagatggaatttttacagaacatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctactttctttgctcacttgttatatttcattacaaatttcttcttcgcaatgggaaaaatggcacgctaaaatttttttattttctgtcatattattattgcttgtcccttttatcggtacatcggttaatggcgcaaaacgttggatttcattggggatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggatttttagaaccctttaaagatccttatggcactggtttccaattaacaaactctcttatagcatttgggcggggagaaattactggcgaaggattaggtaattcaattcaaaaattagattatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggattttctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgattagagataaaaaagatgaaaaataaaaaattattagtgatggcgggtggcactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgccgtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagcttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagtcgcagcaatttttgtaccattccaacataaagatcgccaacaatatttaaatgcgaaatatttatcagatgttgacgcggcgaaaattatagaacaggcagatttaacgcctgaaatgctagtgaattatttaaaaaatttaactcgtgaaaatttattgcagatggcattgaaagcgaaaacaatgtcgatgcctaatgcggcacaacgtgtagctgaagtaattaaacaatattcaaactaggggttgtggcgttttataaatagcctcagtcataagtattttttatatccaaaagtgctaatattagaaataaaaacgttgcgaattttaaccgcacttttagttgagttttgtcattgggagaaaaggaaaaataaatgaaacattcccacgaagaaattagaaaaattatccctgaaatgcgccgtgtacagcaaattcatttcattggcattggtggtgcgggaatgagcggcattgcagaaattttattaaatgaaggttatcaaatttcaggttcagatattgccgatggcgtagtcactcaacgtttagctcaagctggggcaaaaatctacattggtcatgcagaagaacatattaaaggtgccagtgttgttgttgtgtctagtgcgataaaagatgataaccctgaattagttgcatcgaaacaaaaacgcattccagtgattcaacgcgcacaaatgttggcggagattatgcgttttcgtcacggtattgctgttgcaggaacacacgggaaaacgacaacaacagcaatgatttcaatgatttacacccaagctaaacttgatccgacttttgtaaatggtggtttagtgaaatcggcgggtaagaatgcacatttaggggcaagtcgttatttaattgccgaagccgatgaaagtgatgcgtcgtttttgcatttacagccaatggtatctgttgtaactaatatggagccagaccatatggatacttacgaaggcgattttgaaaaaatgaaagccacttatgtgaaattcctgcataatttaccattctatggtttagccgtgatgtgcgctgatgatcctgttttaatggaacttgtgccaaaagttggtcgccaagtgattacatatggttttagtgagcaggcagattatcgcattgaagattatgaacaaacaggttttcaaggtcattacacagtgatttgcccaaataatgaacgtattaatgtgttgctcaatgttcctggaaaacataatgcattaaatgcaacggctgcacttgctgtagcaaaagaagagggtattgctaacgaggcaattttagaggctctggctgattttcagggggctggtcgtcgttttgatcagctaggcgaatttattcgtccaaatggtaaagtgcgtttagttgatgattatggtcatcatccaacagaagtagacgtaaccattaaagcagcgcgagaaggctggggagataaacgtattgtaatgattttccaaccgcatcgttattcgcgcactcgtgatttgtttgatgattttgtacaagtgctttcgctagtagacgctttgattatgcttgatgtgtacgcagcgggagaagcccctattgttggcgctgacagtaaatctctttgccgttccattcgtaatcttggtaaagttgatcctattttggtatcagatacttcgcaactaggcgatgttctcgatcaaattattcaagatggcgatttgattttggcacaaggtgctggtagcgtaagtaaaatttctcgtggcttggctgaatcttggaagaattaatgccagatggattgattgaaaatcttagtattagaaaagtatcatcagtaagaagaacaggatagaaaatgaacttaaaacaagaaaaaatcgcggtgttattaggcggcacatctgctgaacgtgaagtttctttcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacggggtgtggcgtgatggcttctgcattaacgatggacaaaatgcgtacaaaaatgttgtggaaagcttttggtttacctgttgcagatatgaaagtggttacccgagaaactttttctgaattagatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagagttagcaatattagtaaaacgtgcttatgatgcactgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagttgagcctgtaatgaacattctgaaaagaaaaacgccacagaatattcgttttggagaacaaaagcctaaatattattttcatattcgggcttttgcggtattgcttggtgtcttttttttacttggtgtttattttaattggcaaagcattttagaaaaaatggatgataagccgattagtgcatttgcacttgttggacaaaatacctttactactgctgatgatattaaagaaagcctattaaaaatgggcgaattaaaaggattttgggggcaagatgtggcaccgattcaagagcaaattgaggctttaccttgggttaaaggtgcaatcgtaagaaaaatgtggccaaatcgtttaagtatttgggtatcagaatatcaacctgttgcgttttggaatcaaaatcaatttgttacccttgatggtatcgtttttcagcttccctctgtacgtttaactgcaaaaaatttgccctatttgggcgggcccgattatcagagtttgaaagtaattgagacgtggaaccaaatttatattaatttaaaatcaaataatataatggcaaagggaattaatattgatgatcgcggtgcgtggcagatccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataaaaataactgggtgcgaaaatggttaaaggtgtggaaacaaaaacaatagtaggtttagaggttggcacgtcaaaagtggtcgctgtagttggcgaagtatttcctgatggtgtagtgaatgtgcttggtgtaggcagttgtccttcaaaagggattgatcgtggcagcatcactgatcttgatgccgtagtgggttcgattcaacgtgctattgaagcggcagaatctatggctgattgtcagattatgagtgtgactttagctattactggagagcatattcaaagcctcaatgaaagtggttttgtgccgatagcagaaagtgaagtaacacaagaggaaatcgattccgcacttcatacagcaagctcaataaaattgccagaaggcttatctttattgcatgttattccacaagaatacgctgttgatcgtcagatgaacattaaaaatccattgggattacaaggcgtgcgtttaaaagcacaagtacatttgatcgcttgtcatcaagattggcaaaataacttaaaaaaagccgttgaacgttgtggattgcaagtggataaagtggttttctctggttttgcagcaacacattctgtgctaactgaggatgaaaaagatctcggcgtgtgtttaattgattttggtgctggcacaatgaacgtgatggtttatacgaatggcgcattacgttttagcaaggtaattccttacgcaggaaatattgtgacaaatgatattgcgcacgcttgtacaatttcgcgagcagaagcagaacggatcaaagtgaactatgctagtgcattttacccagctcgtttgcacggagataaaaaaattgaggtggcaagtattggcggtcgtgcgcctcgttcattaacaaaaagtgatttatctttaattacatcagctcgttatacggagcttttaggcgtggtaaaagatgaattagataagttaaaagctgaattagaagcaaaacatattaaatttgaattaattgcaggtgtggtaataactggtggtggagcgcagattgaagatcttaaagaatgtgcttcaaatgttttccattgtcaggtgcgtattgcgagtccattaaatattactggtttgactgattacgtgaatcgtccacaatattcaacggtggtgggattattgcaatataatcacagtaatagtgatgatgatttaatttcaggaagtgatgattctgaaggaactttctttgaatctatttggcaaggagtaaaaaaaattgtcaataaagtgcggtcagaattttgattattttaatttttcatctacaataaagggaatttatattttatatatttagtcagcttatctggcagtaacggagaacatcaatgctatacccagagtaccctgagtacgataattttaacgaatccggcgcactgatcaaagtcgtaggtgtaggcggtggcggtggcaatgccgtaaaccatatggtaatgaatatggtaaaacaagaaatgggcggaacctttgttggcgaaagttcattaacatcagaggaacacggtcgcatagtattttatgccgtcaatactgatgctcaagcattgcgtaaaagtcaagttcaacagaccgtacaaattggtggagaaacaaccaaaggtttaggtgctggggcaaatccgaatattggtcgtaaggcagctgaagatgatcaggatgaaatccgtaaaatgcttgaaggtgccgatatggtctttattgcagcaggtatgggtggcggcacaggtacgggtgcggcacctgttgttgctaaaattgctaaagaactgggtattttgactgttgctgtagtgactaaaccttttgcctttgaaggcaaaaaacgtatgcaatttgcagagcttggtattaaagatttatcccaatatgttgattcaatgattattattccgaatcaacaaatccaaaaagttctccctaaaaatgctaaattaattgatgcttttgctgctgcaaacgacgtattgcgtaattctgtaatgggaatttcagatatgattacctctcctggtttaattaacgtggacttcgctgatgtaagaacggtaatgtcagttcaagggcaagctatgattggttttggttcagcggtgggagaacccggtgcgggtagagcagaagaggcggctcgccttgcggtacgtaacgatcttctagaaaaaatcgatctttctaacgctcaaggaattttagttaatattactgctggaatggatttagtttttgatgaatttaacattataggtgagacaataggaagctttgcttctgaagaggcgacggttgttgttggtacgagtttagtgcctgagatgagcgatgaaattcgtgtaactattgtggcaactggtcttggtgaaattgcaggaaatgagccaattcaagttgttcgtcaagggctttctacgcagaatattgaaggcgaagggcgtgtaaacattgttcctgaacttcatcgtcgtgaatctgttgaagtgtcaaggtctgcatcagaagaatatcaacgaccgttagataaaccgattacagatcgcttggaagcatttaagaaaaataatttttttaatcctgcacagcgtgaagaaaattaataagtttcagaaaatacctagtaaatgaaggtagtagaatgattaaacaaagaacattaaaacaaagtattaaagtaacaggcgttggcttacatagcggtaataaagtgacattaaccttacgcccagctatgccaaacacaggtgttgtttattatcgtacagatttaaaccctgcggtggcatttcctgccgatcctaattcagtgcgtgatacaatgctctgcacagcactaattaatgatcaaggtgttcgcatttctaccgttgagcatttaaatgcagctttggcagggcttggtattgataatatcattattgaagttgatgcccctgaaattcctattatggatggcagtgctagtccgtttatctatttgttgttagatgcgggaattgaagaacaaaatgcagcgaaaaaatttattcgcattaaagaatatgtacgagttgaagatggcgataaatgggctgaatttaaaccttataatggtttccgtttagatttcactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagcattaggtggtagccttgataatgcgattgttcttgatgattatagaatcttaaatgaagatggcttacgctttaaagatgaacttgttcgtcataaaatgttagacgcaattggcgatctttatatggctggttataacattatcggtgattttaaagcctataaatcaggtcacggtttaaataacaagttacttcgtgctgttttagcaaatcaagaagcgtgggaatttgtaacctttgaagataaagagcaagtgccacaagggtatgtagctccagcgcaagtgcttatttaattgttttattgttgaaaaagctatatttctggtgggaagtatagcttttttatttcatctcgcgcttaaatatcgaatgtactaaaagtgcggtcaatttcgtgggattttttataaggaagcattatggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagactcggtattgacccagcaagtctacttgcagaataaacttaatgaacaacgtaatcaaaatttacatattgcttttttaggtaaacgtggttcttattctaatttagctgcacgtaattatgctgctcgttatcaaaaacaatttgtagaactaggatgtcagtcttttgatcaagtatttgaaaaagttcagactggagaagctgattttggtgtattgcctttagaaaatacaacatcgggtgcaattaatgaagtttatgatttacttcagcatactgatttatcattagttggagagttggcttatccaatcaaacactgtgtgcttgtcaatgataaaacagatttgagtcaaattgatacgttgtatagtcatcctcaagtgattcaacaatgtagtcaatttattcatagtcttgatcgtgtgcatattgaatattgcgaaagcagttcacacgcaatgcaattagtcgcaagtttgaataaacctaatattgcagcattgggtaatgaagatggtggaaaattgtatggacttagtgtattaaaaactaatattgctaatcaagagaacaatattacacgttttattgtggtggctaaagatcctcgcgaagtttcatcacagattcccacaaagaccttattattaatgacaacttcacagcaagctggcgcgttagtggatgctttattggtgtttaaaaagcatcaaataaatatgacaaaattggaatctcgaccgatttacggtaagccttgggaagaaatgttttatctagaaattgaagcaaatatccatcatccagatacgaaacaggctttggaagaactaaaaaattatagtaattacttaaagattttaggctgttatcctagtgagattgtaaagccagtgagcgtgtaaaaaaagtgcggtcaataaaaatgatgtttttatgaccgcactttttatatttttttgttccgttctaaagatttatgttgaatttgtaccgtttttcctttggcttgaaaatattcgcctaactgctgggcaatataaacggagcgatgttttcccccagtacatccaatggcaatcgtcaaatagctacggttatttttttctaacattggcaaccaagtatcaatgtaatgacgagtgagataaataaattcattgacttctgtatgactatttagaaattctgcgacaggggcttctaatccagtcattgggcgtaatgttggatcccaatgggggttaggtaaaaagcggacatcgaaaacataatccgcatctaaaggaatcccatatttaaaaccaaaagattcaacaataatttttaattctttttcactattatcgcgtaaaaattcgcgtaatcgttctgcaagaatatgcgtagaaagatgggtggtatcaagaataagatttgcgtgttgaatcaatggctcaagatagcgatattcttcatctattgcagcttcaagagatagatcttttaatgaaagcgggtgcaaacggcgtgaatcgctatatcggcgaatcagggtagcgcgatcagcctctaagaaaatgattttaatttgatgatgcttttgtaacgttgaaagggtttgctcaagagaattagcggagcttggaatattacgaatatcgagactaatggcgaccgaagattgagattgagacagaatatcagtcaattgaggaagcaaatctaaaggaatattatcaacacagtaatatcctgtatcttctaatgctcgtaaggctacagattttcctgcaccagaacgcccactaataatgataatttccataaatttccccactgtaattattctttcacttcttcaagtgtcgtttctgattgatcggtaatttcaaaaacttgccaaatttcatccgcacttttggctgatcgtaattgtttcaacacatttttatcagtcagtttttctattaatgatgctaaaactggaatgtagctttcacattgattttctggaatcagtaaggcaaagattaagtccactggtttactatcaacagcatcgtaatcaatcggattatcgagttgcataaacactgcgattgctttatctgatactgttacggggatttttgcttttggcattgcaatcccatttcctaaaccagaattccccagtttttcacgttcaaaaaggcattcaaaacaggcttgttcgccttgttctgcaaggatttgttcttctacaaaatgcgcaatagactcaaataatcgttttttgctagaaaaactaacgccctgacgaatattctcagagcttaatagttcagttattttcatttttataatttgaattgttcgccaagataaactcgtttaacctgttcatcgttcatcacttgtgccggtgtacctgttgcgataattttacctgcaccaacaatataagcgcgttcgcaaacatcaagggtttcacggacattatgatcggtaatcaaaacacctaatcctcggttacgtaagtcggtgataatttttttaatatcgctcacagaaataggatctacaccagcaaaaggttcgtctaatagaataaattttggatttgcagctaaggcacgtgcgatttctacacggcgacgttcgccgcctgataaggcttgccctaaattatctcgaatatgactaatgttaaattcttcaattaattcatctgctttttcgcgacgttgttgtggggttaaatctttacgaatttccaataccgccatcaaattttcatagacagtcaaacggcgaaaaatcgaggcttcttgcggtaaataaccaatgccacgttgcgcacgattatgcattgggagcaaactaatgtcttcgccatcaataacaattttgccttgatcttggcgaacaagcccaacgaccatatagaacgtggttgttttacctgcaccgtttggcccgagcaaaccgacaatttcattagaatttacggttaaactgacatccgaaacaactttacgacttttgtagcttttagctaaattctctgcagtcaaaattgacatagattacttccctttagcttgttgtaattgagatggaataagaactgttgttacccgtgattttccattaccattagctttaagttgttgtttcttcacatcataggtaataacactgccattaattttactatcaagctgctttaattcggcattgttagttaatgttaaaaattcgttgccaagatcataatgaactttatttgcttttccatctattggagtgccattatctagctgttgatggaatgtgactggcgtaccaaatgcttctacagtttcttttttccctgatttttcagcgggacgagtgataacaactttatttgctttaatgatgatagatccctgtgtaattactacattatctgtgaatgtcactacacttttttccatatctaaggattgattatccgaaacgatatttatcggctgattaacgtcatctttcaatgcaaaagctgaacttgatgctaataccatcgttgcaagaaaaagaattttattgcttactaacttcataatatgtttttacctgttcctttaatgtcgccacttgttggcgtaaatttccgactaattttaatcctgtagaactaaaatttttccccttaattttaacctgtgtttcggaagtcatatcctgtgtttttaaattgacgaccgctgattctgtttcaatgcgttgcaaacgagaatctgatgttaaactttgcacgacgacattaccctctaaatacaatatttgatcttttgtcaatcttgcttgatttgcgcttaatttccagttttgtgtgctaaaaaaatctacattttgattgggattttgttccttttcatttgatgttgtgggatataaataaactaaaggcgcggtaaaaagggtttgttcattgactgtataatgctcaattttatcggataaagccaaatattgttttttaccctcaggggaaaaaaccgttgtttccattttataacccacataatcaggactatctggttttttcacaagttcagataaatctgcggtttcctgatttaaggaataaaaccacgccaaagcacaaagtgcgataacgcccaaaattacattccaacgaatattcattttatttcaatcacttatccacaaagtgcggatgaaaatttcaatgtttttaatcttccaacattaataccttgagcatttgataaatttctcgataggcttttgatggtttattttgttccagttctttttgtgcagaacgaatcagattgcgtagttgctgacgatcgccatcaggataatcatttagtaaatcagttaaagccacatcacctttttccaccaattcatcgcacactttttcgattttgtgcaacatagcttgttgttgattatgcttattttcaattttatctaaggcttcacgaataggttcaacatcaattcctcgaaataatttgccgatatactgtaattgacggcgacgagcttctttttgtaaacgctgtgcaagttcaatggcatcaagtaaggattcatcaagtgggattttggcaagattagctttggttaaattgacaatcttttcgccaagttgttttaaatcttccgcatcgcgtttgatttcgcttttactcacccaaataatttcttcttgatcttcatcttcccaatcgaaaacttcttttttcttacgttttgccattttttatcctttataaaaattggtgcacattttaccataaactttgaaaataagataaaatgttgaaaatttttaataggaaaaaataatgaaaacagctgaaaattcaaccgcacttttaaaagcacaagaacaagaattacgtcaagccgtcagttttgcagtggcgttagcaacgaaagctggcgcgagtgcagaagtcgcggtcactaaagtgagcggtttatctgtatctgctcgtttgcaagaaattgaaaacgtagaatttactaatgatggtgcattggggatttctgtttatatggggcaacaaaaaggcaatgcctcgacttccgatttaagcgaaagcgcaattaaaaatgcagtggaagccgcacttgctattgcaaaatacacctcgcctgatgattgcacagggttggctgataaagatctaatggcttttgatgcgcctgatttagagctttatcatgctgctgatgtggatgttgataaagcaacagaacttgcacttcaggctgaaaaggcggctttagaggcggatgaacgtattataaatagtaatggcgcaagttttaattcacatacaggcgtgaaagtgtatggtaatagtcacggtatgttgcaaagttatttatcaagccgttattctttatcttgttcggttattggtggcgtagaagctgccttagaaaatgattacgaatatacaatttctcgtgaattcgacaaactccaatcgccaatttgggtcggagaaaattgtgcaaagaaagtcgtttctcgtttaaatcctcaaaaattgagtacacgagaagtgcctgtcattttcttaaatgatgttgcaactggtcttatttctcactttgccgctgcaataagtggtggcagtttatatagaaaatcgagtttcttgctcgatcatttaggcaaacaggtcttaccagattggttcaatatcagtgagagaccacatttattacgtcgtttggcttcaacgccttttgatagtgaaggtgttcgtacgcaagatcgtgaaattgttgaaggcgggatattacaaacttatttagtgacaagctacagtggtaaaaaacttggtatgccaagtacagggcatgctggaggcattcacaactggcttgttaagccaaatttaacgggaggattgaccgcacttttacatcaaatgggaacgggattgttagtaacagatgtgatgggacaaggtgtcaatatcgttacaggcgattattcccgtggtgcatcaggtttttgggtggaaaatggtgaaattcagtatccagtggctgaaattaccattgcagggcaactacaagatatgctgaaaaatatggttgctgtagccgatgatatagagcatcgttctaacattcaaacgggttctattttgttagataaaatgaaaatttcaggaaattaagaatatttttgaaattgagaataattcttattgacaatgaataaatatctgttactatacacacatctgttaagcgattgcaggttgctccaacaggtagagtagaaagtaaattcgttagggttcaaaaaggctgaaggtttaaacttcagtcttttttattttttgattttttattcgccaaaggaagtttttcagtttataggctgggctttagcccaccctacaactaattaaaaacgtggtgtcgcgggatataacaaactcgtgggctaatgtagggcaggaatacaaaggctgaaggtttaaacttcagccttttttttgtaaaatagcaaacgattttatcccctatcatttcataaggaaacacaatgaaaaaacaccacgtagatgttttaatctcagagaatgatgttcatgcgcgtattgctgaattaggtgctcaaattacaaaattttatcaagaaaaacagatcgatagccttgttgtcgtagggcttttacgtggttcctttatgtttatggcggatatcgttcgtcagataaatttacctgtggaaattgaatttatgactacttcaagttatggcactggcatgaccacgaatcacgacgttcgtattaccaaagatttggacggcgatataaaaggtaaacacgttttaattgtggaagatattattgatacgggttatacgttggaaaaagtgcgtgatattttgaatttacgtgagcctgcgagccttgcaatttgtacgttacttgataagccttctcgtcgggaagtggaagtgcttgttgaatgggttggttttgaaattcctgatgaatttgttgtggggtatggtatcgattacgcgcaacgccatcgtaatttaggctatatcggtaaagttgttttagaagaataatttgattttattgaaaagtgcggttgaaattttaaatgaatttttagccgcacttttttatattatttcattgctattttctcgatcacttgctaaatctttttacagcaaatacagccattatattgataatcttgctggggcaattttcttatttttcggcggctatttagtttattcaggcgtgctagccactgcagccgcattttaattaccaaaaagtataaaatataacgaaagaaaacttgttatttttactgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgcaaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataagtaactggaaatcaataaaaaaatctgcaattgagaattcagttgcagattttttatcgctcaatacttttgactaaaaagtgcggtggttcttttcagtgttttataacttaaatcgatgaataatttgatttgcggaacctcgccaaactaaacttgggtcagcctgttcttgaataaatttcccatcaattaatacatcaatataaggcaacatagcacgttgttgttcgtctaattcatctagcttataacccgtccaaacccagatgtctttatcggggcattctcgttttacacgttgcacaaagggcaataatgtttctatgttacggggatgaagtggatcgccacctgaaagcgtgagaccttggcgtttaatgcgtgtgtcttttaaatcattgatgatttgttgttccattgcgtcatcaaataatacacccgctgaaaatgaccaacttttttggttgtagcaacctttgcaagcgtgcgtacagccactgacgaaaagtgtgcatcttgtgccttcgccattaatcacatcggtcgggtagtattggaggtagttcatttcataaaaatcctaaaaaggtggcttaaattctcgccaaattcaccgcactttttaattaatctttgcaatatgacggtaatttttgcataatagtgcgaaatcgcattgcgatatcaatggaaaccttctcggtctctcgcaacggtgtctggtttactcggtcaggtctggaaggaagcagccaaagtcggaattactgtgtgccgagaagaagctgggaaggtttccgcccaacttccttttctcatactcgctcaatcaatcttttaaagaaaccattttctttagtgattaaactattgtaatcgccttcttcgattaatcttccgctatcaattacacaaattttatcgaattgttcaattgaactgagacggtgagtgaccataattagggttttattttcggcatgttgcagaattaaacgtaaaatttgacgttcagtttcgcgatctaagccttcagtcggttcatccaataataaaattgacgcattattgagtaaaatacgcgctaaacctaaacggcgttgttccccaccagaaagtggacgaccgccatccccaagccaaagatttaaaccttttccctcttgctcaagtaatttacttaagccaacttgatgtagtacttcaatcatttgttcatcagaaattttatccgcacttgcaaattgtaaattttgacgaagtgtatcgctgaatacgtgaacacgttgagttaaaaaacaaatttggcggcgtaatgtctcttctgaataggcggaaatgggtttttctgccaataaaagttcaccttgattcgcatcataattgcgtactaaaagttgaagaagtgaagattttccacttccagttttgcctaaaatagcaatttttttgccctgttctaaatctaatgtaagattttttaatacgagtgtttcttgttcgggataggaaaaatttaaattcttcgcagaaattaaccgcacttttgtttcaaattcctcgttgccattaaactcaacaatcggtttttgctcaatgatttcggtcacacgttctgctgccgcaataacttgacctatatgtaaaaatgctgcccccaatggcatgataatctcaaaggcggcaagtgcagcaaaagtgaaaagtgcaatataagccgtgcgatattcatctgtgccaaaatcggcgttacttgcaaaccatagcattccagaaatcaacaaaccattaagaaagagaacaagtgcggtagagaatccgcttaattttgcttctttggcttgatcttcctgccatgttttttctgtggctgacattttttcttttaatctatcttccgcattaaataataaaagctcggcttgtgcttggataaattctaaaaactgggttcgataggtcgcgcgtgcttggattaagcgttcgccaaattgctgtcctagtcgatagaaaacagttgggataatcattaataaaattaataaaaataagcctaaaccaagtgcgagtggaatattgataaagctaagtccaatggttatggcaatgattacaaatacagcagtgaaaaatggcgcaagtaaacgtaaatagaggctatcaagggtatccacatcggaaactaaacgatttaataaatcgctgttgcgataacgatttaataccgctgggcttaaaggaatgattttttcaaatacttgcacgcgtaatttggacaaaatgcggaatgttgcatcatgcgttactattttttcaaaatagcgcatgacggttcgtccgatagctaaacctcgcacactggctgaaggatagaaaaagttaaatagcgtgcctagtcctgcaatggctgtagcggctaaaaaccagcctgaaacggtaagcaagcccatactagagcccaaacctagaatcattagcaccaagcctaaaataagcgggaatttggcgaatttaaataaacgtataaacggaagtaatgtgcgcattattggatatcctgttgtcgttgagcgagtagttcagcaaagaaaccttgatgttgtaattcggtaaatttaccttgctgtactatttctcctcgttgcatcacaaaaatttgatcacattgtttcaaatcttcaattcggtgtgtaatcatcagtgtagtttgatgctgacttgcttcattcaatgcttgtaaaacaagattttctgattgcgcatctaggcttgcggttggctcatcgagcagaagtaaatcgcctttgcgtaacaatgcccgagcaatggcaaggcgttgcgcttgtcccacagaaatgcctaatccaccatcttttatttcgtgatgaagtccaagtttatcggtaaattctttcgcttgagaacgcattaaagcttgattaatttcttcatcgttggcttgaatattgccaagtagtaagttttctttaattgtgccttgtaataacaatggattttgtcctacccacgcaatatgtttgcgccagtcagctagattactttcgcgaagttcttgcccattaattttgagcgagccctcataaggtaaaaagcccagaatcgcatttattaatgaagtttttcccgcgccactttgtcctacaagcgcaacattatgatttgctggaatttggaagtttaacggcttggttaatgctgaaccctgtgtcgaaagcaccactaaattttcggcagaaatttcaaccgcactttctaaagaaattgttttttcattttgatgtacagttaaataatcagattctaaaaaatcaacaatggcatccgctgcaccaatacctgctgcacggtcgtggtaataggtgcctagatcgcgtaagggttgataaaattcaggtgcaagaattaaacaaaagaaacctgtgaaaagtgtaagcggtgcattataggtaccaaattcaatttgacctaagtagctaaaaccaaaatagaccgccatcagtgcaatggaaatagaggtaaaaaattccaatactgcagaagagagaaaagcgagttttagcacatccattgtggtttcacggaaatcttcagtggcattttcaatatgctcagtttgttcagaagtgcggttaaaaagacgcaaggtttccaaaccgcgtaagcgatctaaaaattgggcactgaggcgagaaagggtatccatatttttttggctgttgtcagccgcagcaataccgacaatgatcataaacagaggaacaagcggtgcggtaatcattaagattaagcctgcagcccagttcaagggaaatacagcaatgaaaataaccactggaacaatggctgaaagactttgttgaggcagaaaacgggcatagaaattatgtaagttttcaacttgttccaacataatgcttgcccaacttccagctggtttttgattgattgtcgcagggccgacaagatgaattttatccagaattttttgacgaatatggttgcgtaataattgtccgctttggaaacctattttttcgcgtgcccataaaataatagcacgcatcccgaagccgataattagcccgagaaaataaggaataagttcatcacgaggcacattttgcataatcagtttatcgagcaacgtcgcaagaaaataagtttgtgcgactaaaatgaatgaagaaagcgtagctaagacaatgtttgcacgcattaattttttgataggttcttgttgtgcgcgaagccatttttgtaaatatttttggcgaagtttattcattgttttggtcgtgattatagaaaaagttcccctctttaaaagagttaaaagaggggaattggttagaagatttatgcttcttgagcatctaaatagcgttctgcatccaaggctgccatacaaccagttcccgcggaggtgatggcttggcgataattgtgatccatgacatcgcctgctgcgaacacgccttccacagaagtggcggttgcatttccttcaagaccagattttacaacgatatagccattatttaattctagttgcccttggaaaattttcgtatttggcgagtgaccaatcgctacgaataagccatctaatttgagttcttctttctccccagtttttgtgttggctaaacgtaatccggttacgcccatgttgtcacccaacacttcatctaaagtgcggtcagtatgaagaacgatttttccttcttccacttttttgtacaaacggtcgataaggattttttccgcacggaagctatcgcgacggtggattaaatgcactgtacttgcaatattggctaagtaaagggcttcttccaccgctgtatttcctccaccaatgacaccaacaggcttattacgataaaagaaaccatcacaggttgcacaagcagaaaccccacgacctttgtagttttcttctgaaggtaagccaatatagcgtgcagaggcacccgttgcgataattaatgcatcacaagtgaaattttgcacatcgccaaaaagtttgaatgggcgagaagataaatctacgcgattgatatgatcgaagacgatttctgtttcaaatttttctgcatgttgcaacatacgttgcattaaacctgaaccagtagtcatctcaaaatcacccggccagttctcaatttcatctgtggtagtcagctgcccaccttgttgtaaaccagtcaccagtacgggttttaagtttgcacgtgccgcataaatggctgctgtataaccagcagggcctgagcctaaaattaaaagttttgcgtgtttgatatctgacataaagaatccttgtttgtagttaagtaataatataatgcaataagttgcattttactgattataaactttttgcttaataaagcagcgaataaagcaatcgacgaaatttatttgtcagcggatcagcattgcccattgcgcttaaaatagataaaaattgttgtttaacttcgccattctgcgcgcttaaatctgtttttaaaatgccgaaaagtagtgttaatgcttcttcatttcgtccagcttgatgaagttgtacggcaagttttattgcaatttcagctgttgggtttttagcataatcagcctgtaattgttggatttcaggtgtatcggctgcttgaatttgtagctcaatttgtgcttgtaatccgtgccaacggctatctcgatcttgcaatggaatttgatttaaaatttcttgtgctggctccgttttcttcattgcaatataggtttccgcatagagcagggcaacatcactgtttttcttatcggaaagttcccatgcgtctttcaacaatggcaatgcggcttcgtaattttctacttgcaagaaatctaatgcttgttggaattttaaatcttcctctttaggtaaaataatgcttaatcgttggattaatgatgctttatcaagcatgcctggaaatgcctctaatgcctgtgcttctttaaacaaataggtggttggcaatgcttggatgcggaattgtgcggcaatcatttgctctttttcacaatctacttttccaagaataaattgtccttgatattgttctgcaacttgctcaagtagcaccaaaaaatccgccgattctttatgggttggcgcgtaaaaattgatgacaagtggtttttctaaggattgttgcagtatttcagtaagattttgttcgttgatctcaacgataaaaggaaaatcagccatgttttatccttgtgaaaaaataatggctgattttagcaaagtgcggaagattttagaaacgttttaccatttctattattaagcaagtttttctaggatcaattttcccatcatttcaatatgtgtatgctctacatttagtgcgggaatatattgataagattgcccgccattggttaagaaattttctcgattttctttatcaatttcttcaatggtttctaaacaatctacggagaaacccgggcaaataacggcaattttttgaatgttctgtgttgcagctgattctaaaaatttatcggtgtaaggctgtagccattcttcacgcccaaagcgcgattgaaacgtcattccccattggttttctgttaagcccagcttattaacaactgcaatagtcgtttgtttacaatgttcacgataataatcgcccattttttcataacgcagaggaataccgtgataagaaaatagtaaaaattcatcggattttaaccgcacttttatggagtttgctaaggcgttaatgtaattttcatcaatatgataagaatggatgaaatcaaaaggcactaatcctcgttcttctttaagggcattagcgaaagcatcaaatactgcgcccgtggttgagctagagtattgcggataaagtggcaaaacaataattcgttcaacttgatttttaagcaaattttttaccgtactttgtattgatggattgccgtacgtcatggcaatttctacttgagcattgatattttgcgtatctaaataggcttgtaatgcgtctttttgttgtcgtgaaatggcaagtaaaggcgaaccttgttctgtccagattgcttgataatttttggcgatacgttttgaacgcaatggtaaaataatggctttaagcagtggataccatttgcaacggggtaaatctaccacgcgaggatccgttaaaaattgccataaataacggctgattgacttcggtgttgggctatctggcgtgcctagattggcaagtaatacgccgatttttgcggattttgtcataaattgattacggaaagggttaatctagaaacacaacaaagtttattctcttctgtgcggatgtcaatttgccaaacttggatatttctgcccaaattaattggcgtggctctcgcggtcactttacctgaactaaccgggcgaagatgattggcgttaatatccaatcccaccgcagttttgccttcttctaaacaaagcgaacccgcaagggaaccaattgtttcagctaaagcaacagaaacccctccatgcaatacaccaaacggctgcatagtacgataatccaccggcattgtcgcttcaatccaatcctcgccaaaagcagaaatttcaatgccaagatggctaactgcactgttggagcaaagttgatttaagttttcgagcgtgaagtttttttgccaaatcatgatgttcctttcattacgctaaaatttctaataatgcctgcacagggtgttttaacaccacatgttcataacgttttacctgactgcggcaagaataaccagttgctaaacaaaagtgcggatctttttcatgcagttttttgtgccaggatacatcgtagatttctcggctcattttttgattttgcacttcatgtccaaatacaccagccataccgcaacatcctactttttctacattaagttgttgtccaaatcttccaaaaatttcttgccattcttttgggctgtttggcataaaggtagattccgtacaatgctggaataaataccaatcgaaagtgcggtcagttttggcgatgttttttaacttctcttgtaaatccgcattttgtaatctttgttttaaccattcgtgtgcggtgagaacgtgaaaatcgccacgtttttcttgtagtgcttctttgtattcatctcgataagacagcacgatggctggatcaacgcccacaagaggaatgcctaattttgccattcgatttaaaaactcggcttggttttctgctgttttgctaaagcgttttaagaaacctttaatgtgcattgctttgccgtttggtttaaatggcaacagaattggtgtgaagcctaatttctgcgtaagcataacaaaatctcgtaccactttcgcatcatagtaagaggtataaggatcttgcacaataaataaaatatcgtttttttctaccgcacttaggccttccaattcttccaaggatttgccttgataatgaatttctaccagctgttgttgcaaattgggttcagaaagcaagggcaaatcggtcatgcctagcgttttttccactaatgtttgcgtgacttttagcttggtaaaataattaaagaattttgcctgttttgccatataaggcgcagcgatttctaaatttgccacaatgtgatcttttgcggggcgtaagtagcggctgtgatagaaatgaaagaatttcgcacggaaacttggtacatcgattttaatcgggcattggctcgcacaggctttacaagcaaggcaagtatccattgcgacttttacttcgtgagaaaaatcataatcgcctcgccattttttaaccgtattgcttagtcttttcacaagtgcggttagttttatttctgttttacggaagtctaattgtgcgggcgaaacattttcattcgccatcaatcgaagccattctcgaaccattgctgcgcgacctttcggcgaaaatacacggtttttactgactttcatcgatgggcacataatgctgtgttcatcaaaattgaaacataatccgtttccattgcagttcatcgcacccttaaattcatcacgcacttggataggaatttggcgatccttatcagctcgcattggcgaaagaatagaataaagttcctcttgggaatccaaaggtgtacagattttgccgggatttaagcgattgttcggatcaaacaaggttttgatataacgaagttcgtaccagagttctggggtaaagaatttttcgccgtaatgggatcgcacgccttttccatgttctccccagagtaatccaccatatttaatcgtaagttctgccacttcatctgaaatttgtttaaataatttcacttgttctttatcgcataaatcaagtgcagggcgaacgtgtaacacaccagcatccacgtgaccaaacatgccatattgtaaatggtgctggtctaataaagcgcgaaattcactgatgtaatccgcaagattttctggggggacacaagtatcttccacgaaaggaatcggtttggctgcaccttttgcattaccaagtaagcccactgctttttttcgcattgcataaatacgttcgatagagggtaaatcagaacaaacttgatagccaataatgtgatcttggttatgttcgattttttcatcaagtaagtgacaaagtgcggtgacttggcggcctattttttctttattattaccagcaaattccacaatatttaaaccgagaattggatctttttcatcttctgtaagaagttcattcacagaatgccaaataatatcttgtttggcgaggtttaagactttggaatcaacggtttccacagaaagcgcattggctttcaccataaaaggtgcattgcgtaatgccgcgtcaaaagaacgatatttaatattgatgagcgtgcgatactgcggaataggcagaagattgagtttggcttcgcaaataaatgcgagagaaccttcagaaccagtgagaattctcgtgagattaaattcactttcatcttcattgaatacatttttgagatcgtatcccgttaaaaaacggttaagttgtggtaaatctttaatgattgccgctcttttttctttacagtgttgcgcgattgtttgatggagtcttttgctgctctcacttaattcaagcgcatcaatgttttctaaaacatcaacagaattgaccgcacttgtatctaaaatttcaccgttcattaatacggcacgtaatgccaaaacatgattagaggttttaccgtattgcaatgaaccttgccccgaggcatctgtgttaatcattccgcctaaagtcgctcgattgctggtggatagctctggggcaaagaataaaccatgtggttttaaaaattgattaagttgatcttttacgacacctgcttgtactttaacccaacgttcttttacattgagttctaagatggcagtcatatgacgagaaagatccactattatattgttattgatggattgaccattagtgccagtgcctccaccgcgaggcgtaaagctgattgattgatattcagataaatttgccaatttggttatacgcactatatcagcaatagttttcggaaaaagaatcgcctgtggaagctgttggtaaacgctgttatccgtagccagacttaatctatccgaataatttgtcgcaatatccccctcaaaatgttggtgttgaagatcatcaagataatcaagtacatattgttcaatttgaggaatgcgatttagacttggcaacatagtatttaactcatttaaaggtaaaaatggcaggttattgataatatcttaaggcgttaatgatgtcgaattagattttgagcatttttaaggagtgttttatggagtaaatgagtcaagaaaagtgtgttgtttggatgaaaaataaacaaaaaattcaaaagaatttgatcttttcaatttttataggataataagcgcacttttgaacgttcctttggcgtaaacaaaggaattgaatttgtcaaaaggtagcaatgaggcaaattcaaaccctcgttaagtactgtttagaagataactttgatgaaaagttcggtctaaacgggaataattttttattactattcgatgactaaatagaggacatcaaaatgaaaaaaactgcaatcgcattagtagttgctggcttagcagcagcttcagtagctcaagcagctccacaagaaaatactttctacgcaggcgttaaagctggtcaaggatctttccatgatggtattaacaataatggcgcaattaaacagaatttatcatctgctaattatggttacagacgcaatactttcacttatggtgtatttggtggttaccaaattttaaatcaagataattttggtttagctgctgaattaggttacgacaattttggccgtgtaaaacttcgtgaagcaggaaaacctaaagctaaacatactaaccacggtgcgcacttaagcttaaaaggcagctatgaagtgttagacggtttagatgtttatggcaaagcaggtgttgctttagtacgttctgattataaattttatgaagttgcaaacggtactcgtgaccacaagaaaggtcgtcacacagcacgtgcctctggtttatttgcagtaggtgcagaatacgcagtattaccagaattagcagttcgtttagaataccaatggctaactcgcgtaggtaaataccgccctcaagataaaccaaataccgcaattaactacaacccttggattggttctatcaatgcgggtatttcttaccgtttcggtcaaggcgaagcaccagttgttgcagcacctgaaatggtaagcaaaactttcagcttaaattctgatgtaactttcgcatttggtaaagcaaacttaaaacctcaagcacaagcaacattagacagcgtctatggcgaaatttcacaagttaaaagtgcaaaagtagctgttgctggttacactgaccgtattggttctgacgcgttcaacgtaaaactttctcaagaacgtgcagattcagtagctaactactttgttgctaaaggtgttgcagcagacgcaatctctgcaactggctacggtaaagcaaacccagtaactggtgcaacttgtgaccaagttaaaggtcgtaaagcgcttatcgcttgtcttgctccagaccgtcgtgtagaaatcgcggtaaacggtactaaataattttagtatttgtttaacgaaagattaaatacagaaaaaggcttaaacttcggtttaggccttttgttttaaatgaatataaaaccaagcatttcaatcaagttttaacttgtgataaaatgcttacctcgtttatttatagggaacattatggaaaccttagacaaaatcaaaaagcaaattagtgaaaatcccattcttatttatatgaaaggttcgccaaaattaccatcttgtggtttttctgctcgtgcatctgaggcattaatgcactgcaaagtgccttttggttatgtggatattttgcaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaatcacagtggaaaaataaaacccgcaataagcgggttttttatataataagtttccctttcattattaaataatagattaagcaaactttaataccttagaaagtgcggtgaaaaatttatcgttttcttcaggtaaaccaatacttatacgtaaatgatttggcatgccataaccagcaattgggcgaacgattacgccttctcgtaacaacgcatcataaattggtgcggcaggttgtttgaaatcaatggttataaaatttcctttagagggaatataatccaattgatttttttgacaaaagtcttcataacgtcgcatttctattcgattattttcagcgactttttcaataaattcatcgtcattcattacggcaactgcagcggttaatgccaaagaattacagttaaatggctgtctaactcgatttaataaatctgcgatttctggattagataccgcataaccaatgcgtaagcctgccaagccataggctttagaaagagtgcgtgaaataattaaatttgaatatttttttaataaactgaaagagtccactcgttcttcagatctagtaaattctgtgtaggcttcatctaataccacgattacattttcggggacttttgctaaaaaatcttcaatttcttgtgatgttaaaaaattacccgttggattattgggattagcaatgtaaatgagctttgttttatcagaaagtgcggttaaaaatccttgtaaatcgtgtccccaatttttagctggaatttcttttgcaattgcatttatcgctttagtcactaaaggataaacaataaaagcatattgtgaataaatgatttcatcgccttccgttgcgaaagtgtgagcaaaaagttctaataaatcatttgagccattaccgagtgtaatttgatttggttgaacgccaaatttttttgcgatagtttgttttagttcaaagccattcgcatctggataacgagtcagtttatctaattgttcgaaaattgctttttttgcactttctggaaaaccaaatgggttttcgtttgaggcaagtttaacgatattggaaataccaatttctcgttctaattcttcaatcggtttaccagcttggtaaggtgataaggattttacgccacgattggcaatgttaatgtactgcatagtgttatttgtaaatattgatatgggttagtatgtatttttaaataaatttgggcgtagtaaatacgcccattggaaatatttttcctattgaggaagattttcagcttcaaattttttcataaatgaaatgagtgcctcaacaccattttgcgacattgcattataaatagatgcgcgcattccacctaaaaccttatgacctttcaaggcttgcaaacccgtagcagtagattctgcgacaaattttgcatctaattcaggattacctgtgatgaaagtgacattcattgttgaacggttttcttttgctaccacattgcggtaaagtttgctcgaatcaatataatcataaagagtttgtgcttttagtgcattacgtttttcgattatttctaagccgcctatttctttaagatgtttaaatacgagggaacataaataccacgcaaaagttggaggcgtgttgatcattgaatctgcatcacgttgagttgcataattccaaatagagggggtttctttacgtgcattaccgattaaatcatcgcgaataatcactaacgtaatacccgcagggccaagatttttttgcgcacctgcataaattatcccaaatttactgatatcgatttgacgtgaaagaatatttgaagacatatccgcgaccaatacggcattgcccacatttggcacatcaaaaatctctacaccactaatagtttcattcgggcaataatgaacgtagtcatattgatcagcgatatggctaaaatcaagatcggtaattcgagtctgttcgccattttctacgatagtgatttcatcaatttctgcaaaatttcttgcttcttttgccgctgtagctgaccaatgcccactatttaaataaagggctttgccttttttaccgattaagttcatcggaattgcggcaaattgaccgcgagcgccaccttgtaagaaaagtacacgatagttatcaggaatattgtaaacctcacgtagatctttttccgcttgggtaacgagttccataaaatactttccacgatggcttacttccattacagaaacaccttgattgagccagtttgtaagttcattttgtgctttttgcaacacttctgggaaaatcatcgcaggacctgcgctaaaattaaagacttgtgacattgtatttccttgctttttatgaaaataatgatgtcttttttatcactacaaaaatcgataatcaatgctttttactgaaatcaaaaaaattctttctatcattcataaaatagagggtaaattttgacgattgattaaaaaaaagctaaattacggcacagtcattttatttattttaaagggagttgttatggaaattgtgaataaacaatcttttcaagaagtgttggaatacgtgcgtatgtatcgtttaaaaaatagaattaaacgagatatggaagacaataatcgtaagattcgcgataaccaaaaacgcatattgttattggataatttaaatcaatatattcgtgatgatatgactattgcagaagtacgcggaattattgaaagtatgcgtgatgattatgaaagccgtgtggatgattatacaattcgcaatgctgaactttctaagcaacgccgtgaagcgagtacgaaaatgaaagaacagaaaaaagcacacgcagaattattgaaaaatgctgaaaaataataggataactagagccgactaaatcagtcggcttattttttataagctattcattgcgttaatgattttaatttcatcaaaattgacaatatcttcttggaatattgtgcgttcttgaattttcccttcttgtaataatttttctcgttgtgtgcctaaaagcaatggcgtgtctggcgtgtaccatttttttccttggcgaaaaattaaattaccgatggaacaatctgtcacttttccatttttgataatcataatttcatcacaagcaccacgttgagcaaataatgtattaattaaactgcgatctaaatatttcaaactatattcaatgtcatcacaaattacaggttgaaaagtgcggtagatttttcgttggtattcaaaatattgaatttgtgtggtttcggcattgtaatcaatgcggcagcgaactaattgattttgtaaatcttcaggcagttgaataagggaaaaaagattaaaaattttcaccgcacttttgccataatattcacgcaaactacgttcatatcgcgcttggtgtaaatcgatattttgaattttcccgttttcaatacaaagggtttcaaatagaggatacattaatcagcaccttcaatcggtaaatagactttttctaataattcttcatattcatcttgcgcattgctatgaatggtaatcccgcctccactatgaaaataaaatttttcatctacttgagaaataaatcgaattgctaccgcactttgtagtgttttgccatcaaatatgccaaaaattcccgtgtaataaccgcgcttttgtttttctgcttgttgaataatttgtgtggttttttcttttggtgcaccactaatagacccagcaggcaacagtttctctaaaatatcaccaatttgattttgccagttttcattcgattttccgtaaatttcagaactggtttgcagtatttcgcctttttgtgttttgatgcgatcgatataacgaaattttttcacttgaatgtgttctgccaccatggataaatcattacgcattaaatcaacaatcgtgtaatgctcgcgttgttctttttcatttgtgagtaactgattttctgcatcgggcagagtggcattaattgtccctttcatgggataggtaaaaatattgttgtcatgaatattgacaaaacattcaggcgaaaagcaaacgaattgatcttgtaaccacaatttataaggtgcattggtttgatgaaaaatttgttcaagtgacagattacctgaaatttcagtggggtaggtgagatttaataaataagaattacctttttgtaattcactttgaacaagttcaaaaccttgttgataatgcgagaaaggcattggatgtttggtgaaattaagagggagagattgtggagaaatcgtgcaatttcttttgcctaaaatatcaaaataaatgccttgttgtgcagaattttcgagaggacaaatcaagggtttttctttttcaaaatcaataagaaagaaaaatggcgtgcgttgtttgccataatgattagcctgttcaataaaatgttgcattgtgctttgtgccattttgcgtaaaatgacctgattataacgaataccgaactgttatgaaattactcatcattaataatcacgattcttttacttttaacttggtggatttaattcgaaaattaaatgtgccttatgatgttttaaacgtggaagatttaaaggaaagtacagcggaaaaatatagtcatatattgatttcgccagggcctgatataccacgcgcttatccacaacttttttctatgttggaaaaatattatcagcaaaaatctattttaggtgtgtgtttagggcatcaaaccttatgtgaattttttggtggtacattgtataacttagagaatgttcgtcacgggcagaaacgaacattaaaagtgcggtcaaattctccattgttttttgatcttccaactgaatttaatatcgggctatatcattcttggggcgtacaggaagaagattttcctgattgcctagaagttaccgcactttgcgatgaaggcgtggtgatggcaatgcaacataaatctttgccaatttatagtgtccagtttcatccagaatcttatatgtcagactttggcgagaaaattttgcgtaattggttggcgattcctccctcaactaacccataataccgcttgcttattaagcaaaaatgcgtattatagccgtctatacgtcaatacatccaaatttaaaagaagaagagagaaaatatgtctagctatttatttacatctgaatctgtctctgaagggcatccagataaaattgccgatcaaatttctgatgcagtacttgatgaaatcctaaaacaagatccaaaagcacgagtagcttgtgaaacttacgtaaaaaccggtatggcattggtgggtggggaaatcacaacctctgcgtgggttgatattgagaatttaacccgtaaagtgatttgtgatattggttatgaacattctgaaatgggttttgatggtcattcttgtgcggtgcttaatgcgattggtaaacaatctgcagatattaatcaaggcgttgatcgtgaaaatccattagatcaaggtgcaggcgaccaaggtattatgtttggttatgccaccaatgaaacggatgtattaatgcctgcagctattacttatgcacatcgtttaatggaaaaacaagctgaagtgcgtaaaagcggtaaattagcatggttacgcccagatgcgaaaagccaagtcacgttaaaatatgaagataataaaattgttggtgtggatgcggttgtactttctactcaacattctgaagaagttagccaaaaagatttacacgaaggtgtgatggaagaaattatcaaacctgtattaccaactgaatggctttctaaagaaacaaaattcttcatcaacccgactggtcgttttgttattggtggaccgatgggggattgtggtttaactggtcgtaaaattatcgtggatacttacggtggtgctgctcgtcacggtggtggcgcattctcaggaaaagatccatctaaagtagatcgttcagcggcttatgctgcacgttatgtcgcaaaaaatattgtggcagcaggtttagcagatcgttgtgaaatccaactttcttatgcgattggtgtggctgatccaacatctatcatggtcgaaacctttggaactggaaaagttgcaaatgaattattagtgtcattagttcgtgagttttttgatttacgtccttatggcttaattaaaatgttagatttaatccaaccaatctatcgtgaaacggcggcttatggccatttcggtcgtgagcaattcccttgggaaaaagtggatcgcgcagaagatttacgtattgcggcaggtttaaaataataggcttgaatttttagtttgaaaggcttatattgaaaaggcaacaaggtttcttgttgccttagttggtttaggttgctaccaagctggggagctaaaggacagcaacaagaacccgataataatcattaagatgatttttatcataaggctatctcctttcagagttgttaaacaaagctgatcgagattgagttactgcctgacccgccagtcaggcaataacgtacctgaccaaccactggttattctatcatataaaagccgcttatctagcggtttttgcttttaccgatgacatcaatatcacttattccattccgtcatttaaaaatgcaagtgcaacgcaaattgaatcagtctttgctgcttgcagaggcttattttaagcgaaaatttacaatgccagaggtaaattatgagttacgaggtataaaggcaggcgtggcttacctacaaaaaaatgaaataaaatttaaccgcactttattgcaagaaaatacggatgaatttattcgacaagtcgtgccacatgagcttgcgcatttgattgtgtatcaaatgtttggtcgcgtaaaaccacacgggaaagagtggcagcttgtaatgaatgaaatttttaagcttcccgcagacacttgccatcaatttgatataaaaaacgtgcaaggtaaaacctttgaatatcgttgtgcttgccaaacccattttctaactattcgtcggcataacaaaataatgaaagaaaacatcgaatatttgtgtaaaaaatgtaagggaaaattagtttttgtcgatgatgaagaataatttttgtgatatatttttccaatttattcaataaataaaggagttatccaatgaaaaaatctttattagcagttattgttggtgcatttgcctttgcttctgttgcaaatgcgaatatttatgctgagggcgatatcggtttatctcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttctaatttttagaatataaaaatcttttttataaaacactttaatttaacggtgatcgtttaaaacaatcaccgttattggtatcagcagagccagaaaggctaattaccatatttggtttaggcgtataacggactccagctgcaacggcagattgtcctcgataagtccctgcagctatgccagtaatttggcgggttatgcctcttattttattccccactgaaaccgaacccgcagtgcctttccaagttgaaactaattcatttttagctgtttcataagatttagttgcgttgtcaatcttagcttgatttggattagctgcggttttcaacttttccatattgctttttaacctagcaacttcctctttttttttcggcaaatcgtaaagaatattacgtaattctgccaaatcagcataattttgacgctctgttttataagcattttccaatggcttaatatcaaaaatatgtgatcaagatcacaaaataaaaaatcccaacggagattgggatttaaaatcactaaaaattttaccgcactttatgctttgcttacttcaaaacgttcaaatgccaatacttttttctctaatttacgtagtaataatgttgcaatgcctgtgataattaaatagataccacccgcaatgccgtaaattgtgattgcatcatattctgtaccataaagttggcgtgcgtaacccataatatccataatcgtaatggtggatgctaatgccgttcctttaaataccaaaataatttcgttactgtaagaaggcaacgcacgttttaaggcataaggaattaagattttgagtgtctgtaatcggcttaaccctaacgctgcgcaactttcccattgtcctttaggaatggcttttactgcaccgtgaaataattgggtggaataagctgcgctgtttagtgctaaagctaatacggcacagaaccacgcattggataagacataccataatgggctgtcaataatccattgaaattggcctggccctgcataaattaaaaagaactgtactaacagtggcgtgccagtgaataaagtaaggtataaattgaccgcactttttatccatttgttttccattgaaagtaaaaaagtaagaaataaggctaaaaagaaagcaatcagtaaggatacgactgtgagtagtaaactcgttggaatcccttgtacgatcacgcttaaatattcttgaaacattatttcatgcccctttcaaaacgagtaaaacgcagctctaattttcgaataccaacttggctaattaatgttaccgctaaataaattaacgcagcaataccgtaccaagtaaagggttgatgagtattggtattcatcagatccgcttggtgtatcaaatcgtccacaccaattaatgaaaccaatgccgtatcttttagcaatacaagccattggttgcttaaaccaggtaaggcgtgacgccatacttgtggcataacaatatgaatgaacgtatagcttttgcttaagcctaacgctgcacctgattcccattgtccttttggtatggcttgaattgcaccgcgtaatgtttgtgaagcataagctgcaaaaatgagagaaagcgcaaacacaccacagccaaatgccccaaattcaatgtattctcctgtcagtatttcgactaattcagtagaaccaaaatagacaagtaatacaacaataatttcgggtaagccacgtaataatgccacaaatactgtcatcggcttgccaacaaagcgatttgcttcaagcacggcaaaaataaggcttaaaaataagcctaagagcaatgaacagaccgcaagccctaaagtcattagagcagcggtaaacattaaagaaagaaagtcagaaaacataaattattttgtcatccatttatcatagattttttggtattcgccatttgctttaattgcagctaaacctttgtttaattgtgcagccaaatctttgtttgatttgtgcattgcaatacctaaaccattaccaaaatattttttattggttactttttcgcctataaattgaatttctggctctttggaaatcatatcggaaagcactgcggtatcgcccaaaataatgtcaatccgaccgctctttaagtctaaaatggcattttgtaaacttgcataggattttggactatattgcttggtttctgctacggtatattgttggaatgttgtaccattttgaacacctatattttttgcactttctaaggttgctttgcctttaagagcaacatagcttgcagagctatcgtaatacgcatcagagaataacacttgttttgcacgagcatcggtaatatcaattgcggaaattgctgcatcaaaacgttttgcttttaaacttggaattaatgaatcaaaggtttcgctcttgaatttacaggttgcttgaatttcttgacaaattgcatttgctacatccacatcaaaaccaataatttcgcctttttcatttgtggtttcaaatggtggatagctaggttccattgcaaaagtgagttcttgtgcgcttacagcaatagatgatcccaataaaatggcagttaataatgtttttttcatcgtaagctccttattttctagtgagaaagatagtgtttaaattgttccgtttttggattttcaaagcaatcagccgatcccatttcgacgattttaccttgttccatatagacgacttttgtcgccactttttgcgccacattgacttcgtgggttacaatcacttgcgtaatgccagtttcttgtaattctttaataatatctacaacttgcgctgtaatttctggatctagcgcagccgttggttcatcaaataatagaacttgtggcttcatcatcagggcgcgcgctattgcaacacgttgttgctgaccgcctgataaatgcaatggaaagcgatcggcaagttgttctaaacgtaaacgttttaacaattccattgcatcagttttcgcttcactttcactcacaccacgcactttcattggtgcttcaattaggttttcaattaccgttaagtgcggccaaagatgatattgttgaaaaaccattcctacatcttgacgtaattgtcggattgctttgggatttgccattgcattggataaattaaaatcattatttgcaatacttaattcaccagactttggcacttctaacaaatttaatgtgcgaattaatgtacttttgcctgcaccacttgggcctagcaacacaacggtatcgccctcttccgcttcaaggttaatatcaaataacgtttgtgatgaaccgtaaaagaaattgagatttttaacacgaatagccatttttcttctctatgctttataagatgaaaaaatattacatttttatgcataattatgcaagtgctattaataaaaaatcccaaaaaatttgggattttaaaaactcgattgaaatcaaccgcactttaggcttgttttgccatttcaaactcaattaacatcattaaaatatgaataactttgatatggatttcttgaatacgatctgcataacgaaaatggggtacacgaatttcaacatccgctaatcctgccatttttccgccatctttgcctgtcatcgcaatgactttcatgccttttgtttttgccgcttcaatagcgtttaaaatattttttgaattgcctgaagtggataaaccgaataacacatcgcctttttgccccaccgcttcaacatagcgagaaaagacatattcatagccaaaatcattacttacacagcttaaatggcttgcatctgaaatcgcaatagcggggtagccagggcgattttcacgataacgacccgttaattcttctgcaaaatgcatcgcatcacagtgcgaaccgccattaccacaagaaagcactttgcctccttgtttgaagctattcgaaattaataatgccgcttcttgaattaatttaatgttattttcgtcagaaataaatttgtttaacacatcttgtgcttctacaagttctgctttgatttgatctaaatacattgattgctccttgttgggaataaaatcgcgatagcattgtatagcagatgaagattcttcgctagcctaaataaaaattcatcttttttcgatgaaataatgattttttgcgatttagatcgaaaaaataagtttgagtggttggatatttttcaagatatgtttatcttgcgtaaacttattagccctttaattttcaaaaacacaatgaaattttaccgcactttgttacttttctttgctagttcttttgcttttgctaactcagatttaatgcttcttcatacctataataatcaacccatagagggttgggtaatgtctgaaaagttagatggcgtacgcggttattggaatggaaagcaattattaacccgacaagggcaacctttatcgccgccagcttatttcattaaggattttccgccttttgcgattgatggcgaattatttagtgagcgaaatcattttgaggaaatttcatcaatcacaaaatctttcaaaggtgatggttgggcaaaactgaaattgtatgtttttgatgtgcctgatgcagagggcaatttatttgagcgtttagctaaattgaaagcctatttacttgaatatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagctcacaaattttaaaattgaaaacagcacgagatgaagaatgtacggttattgcacaccataaaggcaaaggacaatttgaaaatgtgatgggggctttaacttgtaaaaatcatcggggagaatttaaaatcggttcgggttttaatttaaacgaacgagaaaatccccctccgataggatctgtgattacttataaatatcgaggcattacgaatagtggaaaacctcgatttgcaacctattggcgagagaaaaaatgagcctatttataaatctgacaaaatgaatttaatcaatatggaaacaagcgattaattttccatcagtatattgttccaagtgcggttgattttcacgacatttttctgtcgctttccaacaacgaggattaaatgcacagccttttggcggattaattgggcttggcaattcgcctgtcagcttaatacgctcacggcgcaagtttggcgacaaacgtggtgtcgctgaaagtaacgctttggtataaggatgctgaggattagagaaaatttgttctgtcgtccctttttcaatacaacgacctagatacattaccatcacttcatcagcgatatgttctaccacagaaagatcgtgtgaaatgaacacgtaagacaatcctagttcatcttgtaaatccatcattaaattcagtacttgtgcacgcacggaaacatccaatgcagaaacaggctcatcggcaacaacgacatcgggatctaacattaaaccacgagcgatggcaatacgttggcgttgtccgcctgagaacatgtggggataacgatcataaaattcagcgcgcaagcccactttttccatcatcgataaaactttttctcgccgttctttggcggaaagttttgtattgatgattaatggttcttccaaaattgaaccaatctttttgcgtggatttaacgatgcgtaaggattttgaaaaactatttgaatttttttacgacgtagtgcttttgtttcagaatcattttctaaaaaattatgccctttgtaataaagttcgcctttggttggttcttcaatcattgtcaataaacgacctagcgttgattttccacaacctgattcacccacgactgctaaagttttacctcgttcaagctgaaaagagacaccatccaacgcttttacttgctgtggttttgcaaacaagcctttttttacagggtaatatttttttaagccaatggcatttaataatggcgtattttcttttacttcattcgtcattattaagctccttgatattcaactggattgccttgctcgttcagcggagtatggcattttactttatgcgaaccgatatgatgcaattgaggttcaacttggcgacaatattcggtggcataagggcagcgaggatttaataaacagcctgttgggcgatcgtattttccagggacgaccccttgtaatgattctaagcgagattttccctctgcaaattcaggtaatgaacgtaacaaggcttgtgtgtaagggtgttttggctcgcggaaaatatcttttgcggtgccttcttcaacgatttgtccagcatacatcacgataattcgctctgccgcttcagccacaagtgctagatcgtgagtaatcaaaattagggacatgcattctttcttttgcaattcaagtaagagttccataatttgagcttggatagtcacgtccaatgccgtggttggttcgtcagcaatcaataatttaggtctgcaagcaattgccatcgcaatcatcacgcgctggctcattccaccagacagctgatggggataaacatcaatccgagattcaggatcaggaataccgaccaattttaaaagctctaaagtgcggtcttttcttgccttttttgtgccgccttcgtgagttttcaacgcttccataatttggaaacccacagtataagcaggattcaaacttgtcatcggatcttggaaaatcattgctacatcagcaccaataagctggcgtttagctttactctctaaagtgagtaaatcagtattttcaaattgcaaggattcagcagatacacgtccaggatgatcaattaatcccataattgcgagagaactcacagatttacccgaacctgattctcccacaatgccaagcacttcgccttgtgcgacttgatagctaatgcgatccactgctttaaatggcgtttttttatcgccaaagtgaacagaaagttcttttacgtctaataatgccattctgttttcctattgtttgagttttggatcaagggcatcacgcaagccatcgcccattaagttgaaagctaataccaaagataaaatcactaagccaggaattgtaactaaccagtttgccgcttgcataaaaccacgagcttcggaaagcattgtgccaagttctggtgttggtggttttgcaccaatgcctaagaaaccaagtgtcgcgagttctaagatagcattggatattcccatagtcatttgcacaattaaaggggctaaacagtttggtaaaatcacaataaacatgaggcgtaaaatacctgcccctgccactttagatgaagtcacataatcacgatttttttcattcatcatcgctgctcgagttaaacgcacatagctaggaatcgataccacggcgatcgctaaagtggcattggcgagtgatggctctaaaatagagacgacaacaatcgtcaaaagtaagtttggaattgcgagcataatatcaattaggcgaatgataattgtatctagcacgccgccataataaccagaaatcaagccaaggctggtaccaaaggcgcaagatagtaatacgatgataaatcccgcaaagacggaaattcgcgttccataaataatacgcgaaagaatatctcgcccaatatcgtctgtgccgagtaaataagcaggattaccgccctcataccaagcgggtggcagtaaaagtgcggtacgattttgttctgttggatcaaaaggtgcaatataaggtgcgagaatgctgattaaggcaacaatcaaaataaaaattaaaccaattagcgcaccacgattttgtttaaagtaaaaccaaaattcttgtaagggtgtttttggcgcaaaagttaaaggcgtgtcagacataatttctcctacaattaatgacggatacgcggattgaccacgccgtaaagtaaatcgacggttaaatttaccacaataataatcgtcgcaataatcagtacagaaccttgcaacacaggataatcacgggcttgaatggcatcaataatccattttccaatccccggccaagagaaaatagtttctgtgagaactgcaccagaaagcaattgacctacaattaacccgaccacagtgacaacaggaattaacgcattacgcaatgcgtgaacaataacaattcgagtatagcttaaaccttttgcttttgccgtgcgaatgtaatcttcgcctaatacttccaacatcgcagatcgtgtcatacgcgtaataatggcgagaggaactgtgcctaggactattgcaggaagaattaaggatttcaccgcattttcgaaggcacctggcataccagaaagccagctgtcaataagcataaatcctgttggtgtatcgatccaaaattcattatctaaacgtccaccttgtggcaaaccgagttgtggcgaaacatataaaattaaaattaaaccccaccagaaaatcggcatagaataacctgtgagcgatgcagctgtaacggtgtgagaaatccaactgtctttttttactgcggcaatcgtgcctaaaattattccacctaataatgaccaaaataacgcaaaaaaagctaattcagcggtagcaggaaaaagcgtaaaaaattcagtaaggacaggttgttgagtgcggaacgatgcaccgaaatccccttgaattacattgccaatatagtggaaatattgctgataaagaggtaaatctaaacccaattggtgcatcatttgttgatgtacttctgccgttaagccacgttcccccatcagaatttccacaggatcaccgggaataaaatgcacaagggcaaaggtaataagagtaatggcaataaaagtagggatcaccattaagattcgtttgaatacaaatttaaacattccatcactcgtagataataaaagtgcggtaaaaattcaccgcacttttcaaagaaattaatcggtaaaaaatataatactcttgaattctaccgcactttttccaattttgccaaatgcgcaatcaaccatttaatgccttgagcttggaacgctatttgtaaacgtgtgttattttcagatccttccacattaatcactgtgccgaaaccaaatttttcgtgtttaactttttgacccattttccattcattttcgaccgcactggtattcgacaatgaaccgacttttgctaggttcatcgcacgcgtgactgtccctcgtaaacgaatttcttggatacattctctcggtaattctgcgataaaccgtgatggcaaatggcgttcttctttggcatataatcgacggctttccgcataagagatggtcagttttttctgcgcacgagtaataccgacataagctaaacgacgctcttcttctaaacgtccgggttcttcaaaagaacgaaaacttgggaataatccttcttctacgcccaccataaatacacgaggaaattctaagcctttcgcagagtgcaacgtcatcatttctacacaagattgatgcggcgaggcttgttcttcgccagcttctaaggaagcgtgcgttaaaaaggcagtgagttcggtcatttcttccgcattatcaggtttgataaattcacgggttgcggtaactaattcttccaaattttcaatacgcacttcgcctttttcgcctttttcttgttgatacatttcatataagcccgaatgtttaatcacaaaatcagtttgtgcgaaaagcggcatttctgcggtatcaagttgtagtgaattaattaattcttggaaacgtaataaggctgttgaggctcgccctgccaacatattttcttgtgttgcgacttgtactgcttgccataaggtaatttggcgttcacgtgttaagttacgcaatatatctaaagtgcggtcgccaatgccacgggttggcgtattaattacacgctcaaaagccgcatcatcttgacgattattaatcaaacgaagataggctaacgcatctttaatttcttgacgttcgaagaaacgcataccgccataaatacggtatggaatttgacaacgaattaaagcttcttcaataacccgtgattggctattactacgataaagtacagcgcaatcatcaagttttccgccatgttccacccaatcctgaatttgtgaggcgacaaattttgcttcgtctaattcattaaaggcagcatagatgcccacaggatcgcctttttcaccctctgtccataaatttttaccaagacgatcactattgtttgcaattaattcatttgcgctgtttaggatattggcggtagaacgatagttttgttcaaggcgaattgtttcggctttgaaatctttcaagaatttttggatattttctatttgtgcaccacgccaaccgtatatagattgatcatcatcgcccacaatcatgactttgcctgtttttccagaaagaattttgatccatttatattggattttattggtgtcttgaaattcatccaccaaaatatgctgaaaacgttgttgataacgttgcaaaattaatggttttttctcaaataattcatagacccgaattaataattcagcaaaatcgaccaaccctgcgcgatcgcaagtgtcttgatagatctgataaattttaatccattcacgttcttggcgatcattaaaatcttcaatatcatttggtcgcaagccttcatcttttttgttattgatgtaccaacaagcctgtttaggcggaaaagctttttcatcaaaattatgtaattttaataatcgtttaattaaacgaagttgatcttctgaatctaaaatttggaaatcttgtggcaatcccacatctaaatgatgagctcgtaataaacgatgggcaatgctgtgaaaggtgccaatccacataccaactaattgatgttgtgcgtgtttggcaagggtagattgaatacgatgacgcatttctgctgcggctttattggtaaaggtcaccgccataatgctgccttcagaaatattttcgaccgcaattaaccaagcaatacggtgcgtcaatacacgcgttttgcccgatcctgcaccagctagcactaggtgattaccaagaggagcagctacggctttgcgttgtttatcgttaagcccgtcaagtaattcagaaatatccatcataaactatctttaatctgtttaaatttacagttattatagtctcatctatcttgtgaaacaataagatttgtgagtatatcaaaagtagggtagaacattttaagaataatattaagcgggattctcctatatccttaaactcaacatcaaaaccatatgctttgaaagctatttttatactatctataaacaaatttttaattcgtttacctctcattcctaaaatgcaaggtttctcatttttccaaaaatacccatgatgtaatagtataggaatgttgtttaatgacttaatcaatacttgatttgctaggattcctgtaatgattttataaacatttgcttttccttctacttgcacgccattttacgcatagtcggtgattttgtccgaattaagttttaggttaaaaagttactcaaattcaatgttattcataattaatacaaataagaaagagtgagatatggtacaaaatttcaaaaaatggttagcacaaaggaatgggagaagtgtgctatccaagtttcattatgatcactctctaaagtagaaaacgtcatatactaaattatatactgatcaaaaaataatatttccttctattactcaataccaatcaatttatgtgtttgtaaacttagctgccatttaggtttatttgaacgttgattcaattgaccaagtaaagtgatagtctcaagtaaattcattttcccatcaatttcacaaggtgaaagatagtaattctttgcttttattttttgctcgatcaattcacaaaatgatggcatattactgtccattacaatacgtacttcatttgcaaatggaatgcaacgcttttcatacttatgagcataaaggctcttaggactcgtcgcaatataatctatttgtgcaggaattgcttttagaccattggtttcaattgcaagaaaatagccatctgatttaaattgctcaagtaagtattcaatttttggtacaattgttggctcaccacctgtgatgataatattctttgacgaaaatgaccgcactttttctagaatttgtgatacagaccagcgtttaaaattattataaggtgtatcacaccaaggacagtctagattgcatttaccaaatcgtacaaaaacacttggcattcccgtattgaagccctccccttgcagactttcaaaaatttcgactatgttaaagttcggttcaaaatcatgatatttttccatcaacatttactcctgatactcgcaaaatgaagctggggtttcccataaacgaatggatgatatggacagttgttcatcatgttttaaacgattaaaaataaaacgagctatttcttctgccgtagttctaaagggaacaccaaaagtttttgagtttaacttttgcaatagagtggcaatttggctttctcgctcattggtttgatcataaataaaggcgtgatccatcggatctaaaataacttttttcacaatagactttagatctgaaaaatcaatgaccattgctttttttgcacctgattcatataagtcacccgaaatttcaacttgtaatttatatgtgtgtccatgtaaattttgacatttcccatcatgtccatctaataaatgtgccatgtcaaagctaaattctttggaaattttaaacattttttctacctttttgagtcaaatatttctttagacctttattgcgtaaaatacagcttgggcattttccgcatccaccttcgatgccttcatagcaagtgtgagtatgtttttgtacataatctaatacgcctaattcatcagcaagctgccaagtttgggctttagtgagatacattaatggtgttttgatattgaattgataatccatagctaaatttaatgtgacattcattgacttgataaacacatctcggcaatctggataaccgctgaaatctgtttcacatacgccagtgataatatcttgaatgccttggcctttcgcataaatcgctgcataaagtaaaaatagggcattgcgaccatcaacaaaagtgtttggcaattcattctctttttgctcaatatgcgcctgttcatccattaatgcattatgtgtgatagctttcataacagatgtatcaatcaaggtttgtttaatgccgagatcttgcacaatggcgcgcgccttttctaattcaatagcatgacgctgcccatattgaaaggtaatggcttctatgttttctttgccgtattcagcaatagcttggaataaacaagtcgtggagtcttgtccacctgaaaagatgacaatcgctttacgatcgtggtttggattgaaaatattcatattttacctagttttttattgtaggaggtttgcgaactacggggggtattctagtggggaagttctattttagcaagacaagtgaaatatttcgttggatgtgaagtcgttgtgctacaattcgcaggtttttaatttagcaaaaaggtttacttatgaaaaaatggttgttgattatcgcaggcgcgttgattatttcagcttgcgcaaataaggatgtgtattttaacggtgcagaaggttcgcattcaggtgttaaatttgataaagattctcgccaatggggattgaatcaataaaaaagtgcggttgatttttaaccgcactttcgtttttctattggtagaaattattctactttcacaatccagccttcaggtgcttcgatatcaccgaattggatgcctgttaattcatcataaagacgacgggtaacagggcctacttcagtttctgaatagaatacgtggaattttccgttgtgttgaatgccgcccactggagtaatcaccgccgctgtaccgcacgcaccagcttctacgaattgatcgagttgatcgatatacacatcgccttcaatagcttccatacctaaacgctcttttgcgatatgtaaaagagagtatttagtgatacttggtaaaatagattctgattttggtgtgatgaatttattgtcttttgtgatcccaaagaagtttgccgcaccgacttcttcaattttagtgtgagtttttggatctaaatagattgcatccgcaaatttacgttctggcgtaccttgttctgcggctaattcgtgtggaagtaagcttgctgcgtagttcccacccactttcacaccaccagtgcccattggtgcagcacggtcataatcagtcgtgataaagtttgatggagccaaaccacctttgaagtaagcacccactgggcaacaaaaaacagagaaaataaactctggtgccgttttcacgccgatattttcgcccacgccaattaagaatggacgtaagtataaggttgcaccagaaccgtaaggacccaaccaatcttggttagctttaaccacttctttacatgcacgcacgaataattcagttggtacgcgtggcattaaaagacggtctgcggtacgttgcatacgctctgcatttgcttgcgggcggaataagttgattgaaccatctttgcaacggtaagcttttaagccttcaaagcattgttggccgtagtgaagtgcggtagaaccttcgtgaatatgtaaagtattgtctgtggtgagttttccttcgtcccatttgccatctttccagtgagcgatgaagcggtaatctgttttaatataactaaaaccaaggttattccagtctaagtctttcattttacttccttaatattattttttgaatgaaatttcgcttaatctacaccattcctgaagtgatttaaataataaattctcgaaatgatgcaatttttagccaactaaaaaggaataatgaaattttggaaacagggcaggaaataacaatatagttatgctaaaatcgggatgaaaaaaacgccactcaatgagagcagcgtttaaccaaatcggtttaataatatacaggaagtaaatgagtaacaaattgttactcaagttcggtttcccgaactatatgcaaacacaacatcatacttaagtctgaaactcattaactagtaagaaattaccaatcattaagtatggttgtattgtaaggaaaagggtaggaaaggacaagtgacgtttttttattttaggtattagaaaaactaatttgaaataaatcttgtccattatagacgaaaattttataaatggaaatactatatgtataaacgtttgccaccattgaattcactaaaatcttttgagtcggctgctcgttatttaagttttactaaagcagcagatgagctttgtgttacacaggcggcggttagtcatcaaattaaattattagaagaatttttagggattgaattatttaagcgaaagaatcgttctttagaattaacggagcttggtaaagcttattttgttgatattaataaaattctgcgtcgcttaaatgaagcaacagagcgattattaacgttaaaaacggatccgcatttaaatattagcgtgccacaaacttttggtatccaatggttagtgccacatttaagtgaatttaatcagctttatccgcaaattgaggttcgtttaacaggcgtggatcaagatgaaggtttgttaaataaagaaattgatcttgctatttattatggtttgggaaattggcagaatcttcaagtagatcgtctttgcgaagaaaatttattgattttagcctcacctgaattgctagcagaaaatccaattattcagcctgaagatttaaaaaaacacacattaattcacattcatacctgtgataattggcaagcgatggcaaatcatttacagttagatgatttaaatattcagcaagggccgttatttagccatacatttatggcgttacaggcggctattcacgggcaaggtattgtattagctaatcgcttattagccttgcaagaaattgaaaatggctcattgcaagcagtgttgccgactaatttgcctgatccaaaatcattttatgtggtcaatcatcttgatcgccttgatgaccaaaaaattcaagcattccgtcagtggattattaactcaattaaacaagaagaaaatgaataaactcgcattatattgtcgcccaggttttgagaaagaagtcgccgcagagattaccgatcaagcaagtcatttaggtgtatttggttttgctcgagtgcaagataattcgggctacgtgatttttgaatgttatcaacctgatgaggcagatcgccttgcccgagacattccttttaatcgtttgatttttgctcgtcagatgatggttatttccgatttattggaagatttagatcccgctgatcgtattagtcccatcgtggcggcatttgaagaattatcacaacaagttaattttgctcaatctagcgagctttttgtagaaactgcagacacaaatgaagcaaaggagctttccactttttgtcgtaagtttaccgtgcctttacgtcaggcattgaaaaaacaaggttggctttcggcaaaggcgagtcaaaagtgcggtcaatttttacattgtttttttgtaaaaccgaattgctgctatgtgggatattcttatgtggataatcattcctcccattttatgggaatccctcgtttaaaatttcctgcagatgcgccgagtcgatctacgttaaaactagaagaagctattttgacttttattccgcgtaaagaagagaataaacgtttaaatgaaaatatgattggcgttgatttaggggcttgccctggcggttggacgtatcaattagtcaaacgaggtttatttgtttatgcagttgatcacggaaaaatggcggcgagtttgcatgatacggggtgcattgaacattgcgcggaagatggttttaaatttcagcccccaaaaaggaaaaaagtggattggttagtctgtgatatggtggaacaaccaagtcgtatttcgttattgattggtaaatggttgttgaatggttggtgccgagaaaccatcttcaatttaaaattacccatgaaaaaacgttatcaagaagtgatattatgtttagaaaacttggctgttatgttggctgagcagaatttaaattttgatatccaagcaaaacatttatatcacgatcgtgaagaaatcacggttcatatagcattaaaaccttgagtgaattgttttcataaccaaaaaggacgtcgcgaatgaatttacacgaataccaagcaaaacaactatttgagcattatggattacccgtaaaaaatggggcagtctgtcaatctgttgaggatgtcgatttggtactggctcaactttcaggcgataagtgggcggcgaaatgccaagttcatgctggtgggcgtggtaaagcgggtggcgttaaattggtacaggatgtagaggaagcgagagcttttgcagaaaaatggctgggacaacgtttagtcacttttcaaacggataaattgggtcagccagtaaaccagatttattttgaagaaacttgcgatattgataaagaattttacttaagtgcggttgttgatcgtgcctctcaaaaagttatgtttattgcttctcctgctggtggaatgaatattgaagaagtcgcgcaaaattcactgcacttactccataaagtcgagattgatcctttatttggaggattgccttatcaaggccgtgaattggcgtttaaattagggttaagtggtacgcaaaacaaacagtttaccgatatctttatgggcttatctcgtttgtttttagaaaaagatttatctttagtggaagtcaatccacttgttctaactaaacaaggctatttggtttgtctcgacgccaaaatatctgtcgatgataacgctttatttcgccataaagatctcttagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgaaagagcgggttgctgaagcgttcaaaatcattttaaccgatccttccgttaaagtgattttagtgaatatttttggtggcattgttcgttgtgatttgattgctgaaggcgtgattgctgcagtaaatgaagtgggcgtgagagtgcctgtggttgtgcgattagaaggaacgaatgctgaaatgggtcgccaaattttagcgcaaagcgacgttaatattcttacagcacagagtttacaacaagctgcagaattagctgtgaatgcagcaaaaggagaacactaatggcgattttaattgataaaaatactaaagtgatttgccaaggttttactggtggacaaggggcttttcattccgaacaagcattagcctacggaacgcaattagttggtggcgtatcgccaaataaaggtggaaccactcatcttggtttacctgtatttaatacagttcgtgaagctgtcgaaaatacgggggcaacagcgacagttatttatgtgccagcatcattttgtaaagatgccataattgaagccattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgttactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaaccgcactttagttttctaaagcgtagattggctttctacgcctttatttttatatgctcgccattataaagtgagcacaaaattgctataatcagcgcacattttttaaggaagaaacacatgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaacggtaaataataccgcttatcgtttgattaaaaataatacgccagggcgttatacttttattcttacagcaacgaaagaattacctcgccgtttaatgacatcaaaaacgtaaaactattggtttacgcgtaccatataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaacctatagacgcttgtgaaagcgacctttccattattcaaggaaaacaatgaaacctagtcaaaaacaaactcaaagacaaccgcacttttccaaagattcagcaaagaaacgtgatttttcagctaaaaatgacagacgttcagtatctcgtactgctcgcatagaaacagcaaatacgaaaaaaagtgcggttaattctgacaacaaatttttatctaagccaaaagcgaaacctgttgtaagagcctcgaatcaaccgaaagcagagggcgaaaaattacagaaagttttagcgcgtgctggacaaggctctcgtcgtgaaattgaaacgatgattgccgcaggcagagtgagcgtagagggtaaaattgcgactttaggcgatcgtattgacgtacattctggcgtgaaagtgcgtattgatggtcaaatcattaatcttagccacgcacaaaaagaaatttgccgtgtattaatgtattacaaacctgaaggcgaactctgtacacgtagcgacccagaagggcgtgcgaccgtgtttgatcgtttgccgcgtttaacgggatctcgttggattgcggtggggcgtttagatattaatacatcaggtttattgctttttaccactgatggcgaattagcaaatcgtttaatgcacccaagccgtgaagttgaacgtgaatattctgtgcgtgtatttggtcaagttgatgatgcgatgttagcgcgtttacgtaaaggcgttcagcttgaagatggtcctgctaattttaaagaaattaaatttacaggcggtgtgggtattaaccaatggtatgacgtaaccttgatggaaggacgtaaccgtgaggttcgtcgtttgtgggaatctcaagggattcaagttagccgcttgattcgtattcgttatggaaatatcaaactgatgaaaggtttgcctcgtggtggctgggaagaaatggatcttgaaaacgtcaattatttacgtgaattggtgggattacctgctgagactgaaacgaaattagatgtaaaacaggctagtcgtcgtccaaaatctgggcaaattcgtaaagcggtaaaacgttattcggagatgaacaaacgttataaaaaataaggacttttttatgaaaatgcatcaattgcgttatatcgttgagattgtaaaccaaaatttgaatgtcacagaagcggcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggcacgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcgcatacggcattagatgcggatcttgtgctaattgatgcaagccatttgttccgcccgagtatgacgaatattgcatttaaacatagcacgttcttacgtaattatatgtacgattttatggaatatttttcaccgcacttaattcgtagtgtcgtagaaaaagccgagcgtttgcgtgataacaattcagtgaaaaaattatttgaaggcattgaattggaaacaagataacaatgtataaatgaagtgcggttgaaatttaataagaattttaaccgcacttgaaagattaaaacagatcgtgatatttcactaaatctttacgctgaatagcaaatacgcctagtccgccatttttaagttctacccattcaaatggtacatctggatattgctcaattaagctaatcatactattacccacttcacacaccaacacgccattttcggttaagtaatctggtgcttgtttcaaaatttgtttggtaatgtttaagccatcactgccagaacctaaggctaactctggttcaaaatggaattcttctggcatatcggcgagatcttcttcatccacataaggtggattggtcacgataagatcgtatttctgtcccaaaatattttcaaataagtttgattgaatcgggaatacacgatgctctaattgatggcgtgaaatattgatctctgcgacattaagtgcatcaaccgataaatctaccgcatctacttccgcattcgggaaagcataagcacaagcaatggcaatacaaccgctgcctgtgcatagatcgagaatatgatttggttcttgtgaaattaaatcttcaaagcgatcttgaattaaagcactaattggagaacgtggaataatggttcgttcatcgacataaaattcgtgaccgcagaaccaagcgctattcgttaaatatgccacaggtatgcgttgttcgattcgggttaatacaagttgaactaaggtttctttttcagatggggttaatcgactgttaaataattcggtaggtaaatcaatgggtaaatgtaagccacttaaaacgagttgcaggctttcatcccaaggattatcgtgcccttgcccgaagtaaatatcagaacgattgagaatgctatacgtccaacgcagaaaatcttggatggtttgcagttcgtttgcaacattatcttccaagatagttgcaactaattcttggttatgtgaagtttccatcgcatttctccataaaagtgagtagaaaagttagcataaaattcggtatgaaaatttggcgtagttataccacagatgagaatgtagaactatgatatgatacgcaaaatttgaaattaatgagaaaaaaatgcaagacgaatttgatttattccgtgcggaaaccaaaggcattaagccaatgaaacaagatacttttgttgcccctcaccaaaaacgtgatcagaaaaaaatagaattgaaagaattacgagcgaaagaagatacgttattttatttttctgatgaatatgagccgttactgaatgagcatgatggtgttgtgaaatatttacgtgatggggaagattcccatttattaaaacaacttcgtcgtggagatttttcgccagaattgtttttagatttacacggtttaacccgtgaacaagctaagcaagaattagccgcacttttactggcttgtgaaaatgagcatattgattgtgccagtatcatgacgggctatggcacctttacattgaaaaaacaaattccacgttggctagtacaacatcctaaagtgcgggcattgcatcaagcgccaagagaatggggcggtgaagccgcaattttgattttggttgatttgtaaaaaaacgttataaaaaaataccgcacttttactgcctagggcaaagtgcggtattttcttttacaattttgtatgaactattgtgttgcttgaattgcggttaaggcaattgtgtatacaatatcatcaactaaggcaccgcgagacaagtcattgactggtttacgcataccttgaagcattgggccaatagacactaaatctgcagaacgttgtactgctttgtaagtggtgttacccgtatttaagtcagggaatacgaatactgttgctttacctgctactggtgaatttggtgctttagagcgagccacgtcttccatcacagctgcatcgtattgtaatgggccatcgattaataaatcagggcgtttttctttcgcaatacgggttgcttctttcactttttccacatcagcaccgctaccagatgtacctgttgagtaagagatcattgcgacttttggatcaataccaaatgctttcgcagaatccgcagattgaattgcgatttccgcaagttgttctgcagttggatctgggtttaccgcacagtcaccgtaaacaagtacttgatctggtaataacataaagaagatagaagaaacgattgaactacctggtgcagttttgatgatctgcattggtgggcgaatggtgtttgcagtcgtgtgaacggcaccagatactaaaccatctacttcatttgcttctaacatcatagtaccaagcactacggtatcttctaattgttcacgtgctgcggtttcggtcatgcctttcgctttacgtaattcaactaaacgatcaacatagttttctcgaacatctgctgggttaatgattgtaatgcctttacctaatttaacaccttgtgcttctgcaacacgttgaacggatgcaggatctgctaaaagcacacattccgcaatgccacgttctgcgcaaagtacggctgctttgattgtacgaggttcatcgccttcaggaagcacaatacgttttttcgccgcacgagcaagttcagttaattggaaacggaatgcaggtggggataagcgaggtaaacggctagaatctgcaactaaattattgataaagtcagcattaaagtgttggctaatgtattgtttaatattctcaatacgttctttgtcatcaacaggcacttcaagattaaagctttgtaaacttaatgccgtttgccaagtattgccttcaatacggaagatcggcaattttgctttttcaaaagtaggttggcaaagtttattaatttgagcatcaattttataaccgcctgttaataaaataccgccgatttcaataccatttgacgctgcgagagcggctgctacaagcacatctggacgatctgctgaagcgactaataaactgcctgcacggaaatgctcaaccatatttggtaaacttcttgcgcagaaagtgataccacgaatacggcgattgatttccccttcattaatgattgatgcacctaaatgtttgactaagtcgattgctcgtgtagcgattaaatttgcattccaaggcacacaagctaataacttgatggcactacctgcaaataatttgtttacttctgtttcgctaatatgattgtgttggaatgaatcaaagatttcagcaagatcggggcgtgtacgaccagattcatcaacaggtgcattgaatttgtttacaactacgcctaaaagatttggattgtttttaccaccaaataaagaggctgctgcttctacacgatcttttaattcggttggggtttcagttgctggtgctgcaactaatacgatttctgcatctaatgcttgtgcaatttcatagttgatattatttgcataaccgtgttttcttgttggaattaaaccttccaccacaacgatatcgttgtttttggttaattgttggtggttagctacaattttttctaacaatacgtcagactgattttgaccaattaatgattctgccacgcttaacataaagggttcggcagtttcaaggctagtgctagtgcgaataatagaggttgtgcgatccaatttatcttcgccagtgcttggttgagaaacgggtttcataaaagcaacttttgtgcctttttgttcgagagagtggattaatccaagactaatgctagttaaacccacgcctgtacttacagggataagaataatcgtgcgagacatagttaaaccttaatatgtatatgttataaataaaaactgccgaaaaattcggcagtttgttgttgaattagaaacaaagtcttgcggtatcttgtgcgataaccaattcttcgttagttggaagaacaatcgctttaaatgcggaatcatcagtcgtgattacgccatctttaccaaaacgtgcggcaagatttcgttcattatcaattttaatgccaaataattttaagtgattcaatgctaattcacgaacgtgcgctgagttttcgccaataccaccagtgaatgcaatcgcatctaagtgatcatcgcccaacacagccatataagcaccaatgtatttcgctaaacgatagctataaacatttaaagcgcgttttgcttctggtttagatgcattatcgtagttatcttcagcataacggcagtcgctggttacttcagttaaacctaaaagaccagattttttcactaaagtctcttcgatttgttccatagacatacctagtgttttgtatagatagaatacgattgcagggtcaatatcgccacaacgcgtacccattaccaaaccttctagtggagttaaacccattgacgtatcgatacattgaccgttacgcacaacagaaacagaaccaccattacctaagtgacaaataatagcattgacttggtctgcgggtttgcctacatattcagcgacttcacgagaaatgaagtagtgacttgtgccgtgtgcaccatagcgacgtacgccgtgttctttatataaagagtatggaagggcataaaggaatgcttcttcagacatagtttggtggaatgctgtatcaaaaactaccacgtttttatcttttaagtgtgggaatgcgttaaatgcttcgcgaataccaattaagtgagctggattgtgaagtggcgcaaattgtgcagcatcttcaatacctttaacaacttcatcagttacgataacagattgggtgtatttttcgccaccgtgaacgatacggtgaccaattgctgcgatagaattttttagttcatcagtcagaatgttagatgcaataaaattaagcgcttcagtatgcgctgcgcctgcgcctaaatctgcgttacctttctctccattgagtttccatttgatacgtgcttctggtaagaaaaatgcttcggctaagccagataatttttcttcccctgttgctggatcaagaattgcaaattttagtgaagaactaccgcagttaaggataagaacaagttttgacataggaaccctatatttgattgaggttaatagaaatccatcatttaagatggtttgaaaaattaggtataggatacaccttttgatgaataaaataaattcatcggtaaggaaaaaatacaaactttatcgtattttttgaaaaattaaactatttttactaaaaatagacttaaaatagcgtatgataagtgcggtcaattttttgaggtgttttttatggcgtttttttccatttttaaacagggacaaatttatcttaatacttggccgcaggaggcgaagttagggattattttccctgaaaaccgtattatgaaagccacgagttttgcacaaaaatttatgccttttgttgctgtatttgcaatactgtggcaacagatttatgcaaaaaatgatttaatggcattttctatcgcaattttgaccgcactttttgccttgcttattccttttcaagggctttattggcttggtaagcgtgcaaattcgccattagaaaatcaaagtgcggtatggttttacgatatttgcgaacgcttaaaacaacaaaatgaacccttgccttttgtgcaagaaaaaccgacatatcaacatttagcggaagtcttaaggaaagctcaaagcaaatttgaacgtgctttttggcaggaaatttagtttacgcaaacgttttctttttggctgtatttttgtagaatacctcggtcgttttaaacggccgtttttcattgagagattttttaatgatcgattacattattattggcattatcgctttttccattcttgtcagcttattacgtggttttgtacgcgaagtactttcacttggtagctgggttgtggcatttatcgtagcaagccagttctatccttatcttgccacttatcttacgcaaattgaatcaatgtatgtgcgtaatggaactgcaatcgccattctgtttgttctgactttaatcgtgggcgcaatagtaaattatgtgattagtcaattagtagataagacgggtttaagcggcactgatcgcgtattaggtgctgctttcggtttagtgcgcggtgcattgattgtggctgcgttgttattttttatggatacttttaccaattttgaacaaactgattggtggaaagaatctcaattaataccgcattttggttttattattgaatggttctttcaacagcttcagtcaagttcaagttttttaaatccaacgcttaatcaataaggaacacaaaatgtgtggtattgtcggtattgttagccaaagtccggttaatgaatctatttatgcagcattaactcttttgcaacatcgtggacaagatgcggcgggtattgtaacggttgatgatgaaaaccgtttccgcttacgtaaagctaatggcttagtcagcgatgtgttccgtcaagagcatatgctacgcttgcaaggaaatgctggattagggcatattcgctatcctacggcaggaagttctagcgtctcagaggcacaacctttttatgtaaattctccctatggtgtcactttggtgcataacggcaatttaaccaactcagtggagttaaaagaaaaagtctttaaaactgcccgccgtcacgtaaacactaattcagattctgaacttcttcttaatattctcgctaatcatcttgatcacattcctcaaaaccatcttgatccacaagatattttctatgctgttcgtaaaactcacaatgatattcgtggtgcttatgcctgcgtagcgatgattattggacacggaatggttgcatttagagatccttttggtattcgtcctttggtgttgggtaaacgtgaagaaaatggcaaaactgattatatgttcgcctctgaaacagtagctttagatattgtgggtttcgagtttgtgcgtgatattgctgcgggcgaagccgtttatgtgacatttgatggcgagctttattcacaacaatgtaccgaaagtgcggtgttaaatccttgtatttttgagtatgtttattttgcacgcccagattcaacgattgatggtgtctctgtttatgcggcacgtgttcatatgggggaaaaactcgggaaaaaaattgcaaaagaatgggcggatgaaattgataatattgatgtggtcattcctattcctgaaacctccacagatattgcgttacaaatagctcgtgttctagggaagccttatcgacaaggatttgtgaaaaatcgctatgttggtcgtacctttattatgccaggtcaagcacagcgtattagttctgttcgtcgcaaattgaataccattaaagctgaatttaaagataaaaatgtgttattggtggacgattctatcgttcgtggcacaacctctgagcaaattgttgaaatggctcgctcagctggtgcgaagaaaatttactttgcctctgcagctcctgaaattcgttatccgaatgtatatggtattgatatgccgagttgtgatgaactgatcgcttacggtcgaaatgttgaggaaattgcacatttgatcggcgtagataaattaattttccaagatctgaccgcacttactgaatctgttcaattggaaaatccagccattcaaggttttgattgttcagtattcacaggcgaatatattacaggcgatattagtcctgaatatcttgataaaatcgcacttcaacgcaacgatagtgcaaagaaaaaacgtgaaaaacaagcatccaatcttgaaatttataatgaacaataaattgcgataaggtgagatatttagtccgataaaaatcaccgcattaaaaaagtgcggtgattttttatttgttttttaggatttcttctagatagtttttgcaatcagaatactgaaattggaatccagcgttgagtaatttttcaggcacaacattttggctttctagtaatagattcgctcgttcgccaagaatgaaatgtaatatccattttggaatagttgcaaaggcaggacgttttaatattccagccaaagtgcggttaaatttatgctgttttatgggattcggggcggtgaagttaaatgatccttggcattctgaatggtcgagtaaaaataaaatgccgtttaccatatcttccaaagcaatccaagggaaatattgctctccattgcccagtttaccgccaagtccccatttgtataaaggcaacattttagcaagtgcgccaccttttgtagaaaagaccatgcctgttcgaatcaaacaaactctcgcattagcttgttgagcgatattttcccaatcttggcataattgtgcggtaaaggtttttgctgttttgcttgtttcggtaattttttgttcgccttgatcgccgtaaattccagttgctgaacctgatataaaaattgggtattgctgatactgattgatgaattcaaccagttgagtagtgaggcttaaacgactttctcgtaaaatagatttctggtttttcgaccaaactttatgaaaaattggttcgccagcaagattgatgatggcatcaaactgttcttgtaaatcgagttctgaaagtgcggtaataaatttgatgtttttttgctttgagagagtgtgcggcgaacttgagcgcgttaagatcgtcacttgttcattacgtaagcaaagttgttcaacaagtgctttgccgataagccctgtgcctcctgttaataaaatattcattacaatgcgttttcaaataaacgttggatattttgcaataattcagcaataggtttatcgtttgtgggcgtgacaaaaatagtatcatcgcctgcgatagtgcctaaaatgccttccgattttccaatggaatcaagtaatcgtgcaattaattgagcagcaccgggcgtcgtttttattacgattaacatcgaattgtgatcaacatctaagacaagattttttaatggactactggtattgggaacacttaattcatttggtaagcaatagaccatttccatttttgtattacgagtgcgaaccgcaccaaatttgctgagcattctcgatatttttgattgattaataccagtaaagccttgtttttttaaggcatcgacaatttcattttgagaaccaaagcgttcttgattgagtaattctttaaaagcacgagttaaattgtcagtcatctttattttttaatagtcaaaatttgcataagaattgcataaaaattcactttcatcaactgaaatatgaataagaacaaagagaagaaaatatttatctcagaaatgtgaactagatcatagaatgatatttctctatttgtaattgtaagatgaacattttaaaatcagtctgttttaaattaactaacacataaggagtatttatgaaagttgctgtattaggtgccgcaggtggtattggtcaagcattagcgttattactaaaacttcagttgccagcaggcaccgacttagcattatatgatattgccccagtaacaccaggtgttgcagtagatgtgagccatattccaacagcagtgaatgtaaaaggtttttctggcgaagatccaactcctgcacttgaaggtgcggatgttgtattaatttctgctggtgttgcacgtaaacctggtatggatcgttcagatttattcaatattaatgcaggtatcgtgcgtggtttaattgagaaagtcgcgattacttgcccaaaagcttgtgttggtatcatcactaacccagtaaatactactgttgcgattgcggctgaagtgttgaaaaaagcaggcgtttatgacaaacgtaaattatttggtgtgacaactttagacgtgttacgttctgaaacttttgtggctgaattaaaaggtttaaatgtttctcgtaccagcgttcctgttattggtggtcactcaggtgtgactattcttccattactttctcaagttcaatatgcaaaatggaatgaagatgaaatcgaaccattagcaaaacgtatccaaaatgcaggtacagaagtggtcaatgcaaaagcaggtggcggttctgcaacgctttcaatggcgcaagctgcggcacgttttgctcgttctttagtgaaaggattaagtggcgagacagtggttgaatgtacttatgttgaaggcgatggcaaatatgctcgtttcttctctcaacccgttcgtttaggcaaagagggtgtagaagaaattttaccaattggcccattaagcaattttgaacaacaagctttagaaaatatgttgccaactttacgtgcagatattgaattaggcgaaaaatttattaatggttaatcgttaaacaataagaagggaatataaaattctctttttattaaaataaaaaagccaccaaatggtggcttttgtttgtatctttattatttctgacgcattgcagggaataagatcacatcacgaattgatggtgcatttgcataaagcattgctaggcggtcgatacctaaaccttccccagctgttggtggtaagccgtgctctaatgcaacaacaaagtcttcatctttaaacatcgcttcatcatcgccagcttcttttgcagccacttgtgcatcaaaacgttcattttgatcttctgcgtcatttaattctgagaaaccattaccgatttcacgaccaccgataaagagctcaaaacgatctgttacatctggattttcatcattacgacgtgcaagtggagaaatttccgcaggatgagccattaagaatgttggttgaattaagtgatgttcagccacttcttcaaaaattgcattgacaatgctgcctaaaccccaagatttttgtacttcaatacctaagcgttctgccgtggcttttgcacgatcaaagtcatataaatcttcttttacgatacctttgtctgcaccatatttaaccgttgcatcgtgtaacgtaatacgttcgaatggtttaccaaaatcaaattcgtattcgccgtatttcacaatagtagtaccaagaatatcaatcgctaatttacgaagcagttcttcggtgttatccattaaatcatggtaatccgcataggcttgataatattcaagcatagtaaattctggattatgacgaacagaaaccccttcattacggaagttacggtttaattcaaatactcgttcaaacccaccaacgactaagcgttttaaataaagttcaggtgcgatacgtaaatacatatccacatctaatgcattgtgatgagttacgaaaggacgcgcagatgcaccgcctggaatgacttgtaacattggcgtttccacttccataaagcctttagaaatgaaatattcacgaatccccgcgacaactttagaacgaataataaaagtgcggcgagattcttcgttagaaattaaatctaaataacgttggcgataacgaacttcttggtcggttaaaccgtggaatttatctggtaatgggcgaagtgctttagttaaaagttgaacctcagtggttttaacggtaagttcatcggtttttgttttaaataaagtgcctttaacgccaacgatgtcgcctaaatcccaagtaccaacgtcatctttataaacaccttcaggcaaattatcgcgtgcaacataaagctggattttactgctcatatcttgaatagtgataaacgttgctttacccattgcacggcgagtcataatacgaccagcaacttgtacttcaatgcttttctcttttaagatttccccgtcttctgaatcatattgattgtgcaaatcttgtgcgagcgcatcacgacggaatttattcggaaaggcattaccttttgcacgcaatgcggctaatttttcacgacggacgagcatttcgccattgagatctaattctttaacttcttgttctgacatgttgtttacctttaattttaactttaaaaataccttaaaaaataaccgcacttttgggttatttctatgatgggataagtaacgcgtctttacttatccagcaaatcatgcttaaagcccagcttttaaactcgcttcaataaatcgatctaaatccccgtctaatacggcttgcgtattacggttttccacgccagtacgtaaatctttaatgcgtgaatcgtctaatacgtaagagcgaatttggcttccccaaccaatgtcagatttattatcttccattgcttgtttatccgcatttttcttctgtaattcaagctcatacaatttcgcttttaattgtttcatcgcttgatctttgttcttgtgctgtgaacggtcattttgacattgcaccacaataccacttggcatatgggtaattcgcaccgcactttcagttttgtttacgtgctgcccaccagctcccgatgctcgataaacatcaatacgtaaatcagcaggattgatttcaatatcaatatcatcatcaatttcaggatagacaaatgccgcgctgaatgatgtgtgacgacggttattggaatcaaatggacttttacgcactaaacgatgaatgcccgtttctgttcgtaaccaaccaaaagcatattctccgctcactttaatggttgccgatttcaatccagctacatcaccgtcagagacttccatcagttctgttttaaaacctttgctttcagcccaacgaagatacatacgcagcaacatttctgtccaatcttgagcttccgtaccgccagaaccagcttgtaagtccacatagcaatcgcaagcatcatgttcgccactaaacattcgacggaactctaatttttcgagttgttgttcaagttcatctaattcagcaaccgcttcattgaaagtgtcttcgtcttctgcctcgatggcgagttctaacaagccatcaacatcttctaagccttgttctaaatttttgatggtatttacaacttgttctaaagaaacccgttctttaccaagcgtttgggctttatctggatcattccaaacatctggctgttctagttccgcattgacttcttctaaacgctcaactttggcatcgaagtcaaagatacccccgaagcaccgaagtgcggtcagataaatcgatgattttattttttacaggattgatttcaaacataataaattcactgtgtgataaagtgtggaattatatgctattttctgatttttggatagtttgaccttgcagaaattagcaatctctctataattttaggctttctcactcaagtaaatttaggaacaaaaaatgaagaaaatttttaccgcacttttgtgcgtggctgcggctaatgcaatggcagatgatgcggcaattaaacgcaaattacagtcttttaatgtgtcaaatattgctattaaatcttcgccgatttcaggcattagaacggctgtcacggatcaaggtatactttatgtgagcgaagatggaaaatatctttttgaaggtaaactttatgaactcacaaataatggccctgttgatgtagcaggtaaaattttagtagataaacttaattcttataaagacgagatgattgtttatcctgcgaaaaatgaaaaacacgtagtaacagtatttatggatattacctgccattattgccatttgttacatcagcaattaaaagaatataacgatcttggtattactgtgcgttatttagctttccctcgtgcaggtatgaataatcaaacggcgaaacaaatggaagcgatttggacggcgaaagatcctgtttttgctttaaacgaagctgaaaaaggcaatttaccgaaagaagttaaaacgccaaatatcgtgaaaaaacattatgaattaggtattcaatttagtgtacgaggaacaccaagtattgttacctcaactggtgagcttattggcggttatttaaaaccagctgatttattaagagctcttgaagaaacggcacaataattttataatgaaaaacaaggggcagttgcctaccccttgtgtttagtcggttatgcttaatatgctggggagcttaaaagcattaacaacacaaaaattatgatataaatacataatttaggcatcattaaaatccttagctgacacaatcgttagactaatggtcagtagggcttttaacccctgtcagcattcagggttaaaagccctgaccgacaggaaaaagtatagataaaagagctgttgatttcaacagctttttgcttttaggtatgaattaatatccagtgaaaaaacttatcaaacgccgtgaaattccagttggaaattctgtttcaaaccatcccttattagatcgcctttatcgtgctcgtcatattaaaaacaccaaagaattagaccgcactttgaaatcaatgctcaatccaaatcaattatatggcattgatcaagctgtaaatttattagttgaagcctatcaacaacagcaaaaaattgtgattgttggggattttgatgctgacggtgcaaccagcacagcattgagtgtgctggctttaagacaacttggcttttctgatgtggattaccttgtgccaaatcgatttgaacaaggttatggcttgagtattcctgtggctgaaatggcgattgaaaagggcgttcagcttttaatgacggtggataatggcgtttcgtcttttgacggtgtggcatttttgaaagaaaaaggcattcgagttttagtcacggatcatcatttaccccccgaaactttgccgccagccgatgctattgttaatcctaatttaagtcagtgtcatttcccttcaaaatccttggcaggtgtgggtgtggcattttatttgatgttagccgtacgagcaaaatttcgtgaactcggtatttttacggcagaaacacaacctaattttactgatttgctcgatctggtggcactaggcactatagctgatgttgtgcctttagatcaaaataatcgtatccttgcttatcaaggtttaatgcggattcgtgcacggcgttgccgtcccggtattgttgcgttggcagaagtggctaaccgtaacgtagagcagtttacttcaagtgatctcggtttttgtattgggccgcgtttaaatgcagcagggcgtttagataatatgtcgattggggtagagcttttgctggcgaacgaaatgtcaaaagctagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaacctgattggcatcaaggcgtattaggcattgtatcatcaaggattaaggatcaatatcatcgtccagtgattgcctttgcacaagatagtgagggaattttgaaaggttctgctcgttctattgaaggtttacatatgcgtgatgttctggagcgtattcattcgcaacatcctaatatgattttaaaatttggcggacacgcaatggcggcaggcttgagtattcgcgaagaacattttgccgatttccaacatatttttaatcaaaccgttgccgattggcttgatgaagaacatatgcaaagcataatttggacagatggcgaactaaattcaaatgaatttaatcttgaaacggcagagctgataaaatcggtaggcacttgggggcaagagtttcctgagccttgctttgatggcgaatttaaaattttagaccagcgcgcaattgggcaaaataaaaatcatctaaaaatgttgctagaaccgaaacaaggcggggttttattagatgcgattgcatttaatattaatacaagattgtatcctgatctttcaattaaacaggctcgtttagcctataaattagatattaacgaatttcgtggcaatcgtagcctacaattattggtagattatattgagccgatagatgagtgatagaatgaaattaaagggaatattggcattttgtttgctttttttatcgtcgtttgttttagcagaagtcaatcagaaagaattttcagtgcaaaattctccgcacttgccatcaagggacacaatctattttgaagacgggcgtgattatttttcttataaagaacctattgaacaagtgtctcgagcggataaaaaaatccgcattcaattcttttttgattatgattgtcgagtgtgttcttcagcgcaggatattttagaactttatagccaaatacgcacatataaagttgtgttggaacaatatcctattgcaactgccgatagccagtttagcgcacgtattttttatactttgcaagcattaagtgcgagcgaattatccaatgttttgttatttgaaacttcagaaaaatcccgttatacagaattgtccacatcaaataaaattcagcaatgggcggaagaacaagggctagataagcagttatttattcaaactgaaaattcacaaagcgtaaaagaacagatccaaaatgcgattgaattgacggaagaatatggtgtttttacctatccttacgttgttatcggtggaaaatatgtactcactgcaagtacgctttataacgatgattatagcgtagcagtgttagattttttggtaaataaaatagaacaggaacaaaaacaatgaaaataggaattgttggtgcaatggcacaagaagtcgaaattttaaaaaatttaatggctgatagaacggaaactcgagtagcaagtgcggtcatttttgaaggcaaaattaatggtaaagatattgcattattgcaatcaggcattggcaaagtggcagctgcaattggcacgacggcgttattgcaattagccaagccagattgtgtgatcaatactggttctgcaggtggggtagcaaaaggcttgaaagtgggggatattgtgatttctgatgaaacacgctatcacgatgcggatgtgacagcttttggctatgaaaaagggcagttgcctgctaatcctgctgcatttttatcggataaaaaattggcagatctcgctcaagaaatggcagaaaagcaagggcaatcagtaaaacgtggtttaatttgttctggcgatagttttattaatagcgaagacaaaattgcacaaattcaagcagatttcccgaatgtaatgggcgttgaaatggaagccacagcgattgcacaagtttgttatgcttttaatgtgccttttgtggtggttcgtgctatttctgatggcggcgatggcaaagcaagtatgtcttttgaagagtttttaccattggcggcgaagcagtcttcggcattagtattagggatgattgacagactgtcgtaataatcttttaataagataataaatgctaaaattgaaggcatagctattagctatgcctttttatatgaacctattagaatttatagtttaaactcagaatataagttcttccacgtgcaaagttataaagcacggttttatcttttcctccatcttcacaatcctgacttttactacaaattgaatcatttaaacttgaataataacgttgcgaagccgcatcatttccagcatctaacggatcaacataacgtttatctaatagattttgtacttccgctttaataatcaaatctttgattggttcatagctgacgtgtaaatctaaaataatcggttgttttttaatctcttctgtttttttcacaacgtagtaagttcttttacctgaggtctttaattcaaagtgagatccattgatatattcttcttcaattgtcgcacgtttactttttccataataacgagctgccatacctaaggttaatttttgatcaaaccaacgtgtaccaatctctaatctgccgtagtcttttggtagcattgaaacacgagataagccataaccttgtttcaaaatgtcttcttttgaagcattattcggacgtgagctggcatcggcataattggttggctgattagtacgttgataagcgtaagagacattcgcaaaaaaacgtcccatatcataattaagctctaactccgccccgctttttttcacgataggttgataattttgatgtgcgatagtaaagcgaaaaccagtactgtctgcccacgtaggtacaacgccatctcgccaccaaacaccgtaaacattatggatatagtttttaataaagctacgataacccactaatttgatgcctagcacatcgtcttgagtgaagagaccttttttataagtattaaagcctagttgataggtatcagattgttcaggttttaatgccgtgtttacccctgcattagacacttgagagaaaaacatctcttgaatattcggcattctgtgtgtgcgtgaataagtgaaaaatggcataaaataatcgcttagctctgcacttaatgtagcggaatgattgaatgcctttttatgccctgatttatgcaaaatcggttcattaatttgattcgctgtattttcatatccaacatactcaccattaaacgcataatgggtaaaattcacgctgtaatttaaatggtaaatacctttagaaagtgcggtatcaaaatacaccgttttaaatttttgcttgccagaaggttgtaaaatcactgaacgttgtggcagtaaattacgattacctctaaatcgtcctaaattactatagttaccttgatcatgtgaatcatcgttataaaacaaacttaattcttctggaaaacggtttttactgtattcattggtaaaatagttaaaacctaatgtggtttttaaatcgatttcttttggcaacaagaaagtatggctgttgtttatatcaacaatatttgccacatttttggtaataagtttgtctgccactcgccagccagcaaaaaaaccacccttaggataaatggttttaccaatgttatgtgcagccattaaattaagatcgagatagttgttattattgaagttataattgacttggtaattacggttttcaattttgcgagaaccaattttattatccaatgtacgtatttgtgctcctaaattttggtgatcatcgccatattcaaattttaataaatggctacgcgagcgtgattgcaaactaccaggctcaattggtgcaacactatattgatctttattacgttcaaatgatttgtcagtttctttaattccatccttaccgttttggagctcgtcaatattctcaggttttgttccagcttttaattttttgagaatttcttttctatcgttttttctaggatcaaaagaataatgtgtacatttaacattctctatattctctgctaaacgaggagggtcttcgttacaagaccaagcgttcttacttagatcaggagtccactgtccagcatcatttaaaacataacccgcattacgaaaataagcttctttttctttcgcgagaatatcttgccctaatgatgctaatcgttctccgcctccaatacggtaatcttgtgaaacttcacgttggctataaccatacaccacgcctacatagccaccattatcaagccattttctgccagcagccatcgtcataaaattggatttagtggcattgcttcctgtcattcctttcagaataatgccaaatggtttgtcatcggtaataacatcattaacgcctaatgttctaaaattagcactgcctgctaacgcatttataccgcttgctcccgaaaagttacttttattaacatctacacctgcaataaaattaggatcgattgccgcaccaaattgagaacttccgcctgattgaccagagtctaaggctgtagaatagaaggtttgggttacaccatcaaccatcgtattgacacgacctaatccattttcgccacgaatatttacagaaacgacacccgagcctttatcttgttgagtaaatgccccaggaatgctccgaatcacttggtcaatggtttgtgtttccttaaagacattttcacgtgtacttttggctttggcttcagtgaaaggttttttatcgtttgatataactttttccactacatcaatttgtcctaatgtttcttcggcttgagcttgtgtaatcgtcataccgattgtattaattaggccaagtgtaattaaatttaattttatagctttcttcattatagttcctatttatttttgagaaatattacgattatccattttataagagggatttcaaggaatgatttaataaatttaatgaaaatacctaaaaaaataatgaaaaaaattaattttttagagaggaaacacgtttagaagatagagaaaaagaaaggttgatttttgcgaaatggacaaatttattcgctaaattaaccgcactttaatgggttaaagctcatttttgatagtagaaacataaaagagaaaaataggaaatgaccgcaaaagtgcggtcatttttggcgtaaattttatagattataaaataaaggtactaagaatagcgcgccaagtgcggcaatgataccgtaaatgatcataggtataatggttttcttaataattgtgccttcttggtttgaaatatttaacactgaacttaccgctacaatgttatttatacataccatattccccattgccccaccaacagattgtaaagcaagaacaagtgcgacagaaatgcctgttgtttctgcggtagaaagttgaacactaccaaatgttaggttagatacggtatttgaacctgagaaaaaggatccaatcgcgcctaagaaagaggagaaaatagtccagttactaccagaaatttcagcaaaagttctacctataatttttaccatagaatgttcgccacccactaacattaggtttaccatcactaaggcaccaactaaggcaataaatggatttttagattgttgtaaacttgatacaaaaatctgtttaacatttgaactggaaattttaaagacaggaatcgcaattagtactgtaatgacaaatggaatcaatgcgggtacgtaaagaagtttatagcttgatgaaacatttgagccaaaaatattttttaagctaaagattaaacctttgctaatttcaaataatcctaacgaacctaatgtggttgagaaccaaatagttgcatcattcatcattgctttgaatggtaattgatgaatacgagtcacaattaaaaatgcaataagtaaacctgtagggaataatgctttaactacttctcccgtacttaccgcattattatcaagggtatttgttacttttgctaaaccaatattgcgattagcagcccatacagaaataaataagccgattgcccccccaacgagtgatggaaattcgtaattgacttgagcaatcaagaaataaggtactacgcaacccagtacgctaatatagataaatacgatgtttttacgaatatcatcccaatttactaagatacgaagtgctaataatgggataataagtgcagcaatggagtgtataaatgctgtaatagacccaatttctaaaatcatatcttctgataattttaaagcaccaaaaccaaaccaagttggtgtacctaccgcaccaaaggatacgggaactgagttcataataagtgccaacatcgccacttttaatggatgaaaacctaatcccactaaaataggtgcagcaattgccgctggtgtaccaaaaccacttgctccctcgatcataaaagcaaacgcccaaccaataatcattaattgtgcaacgggatttggattaatatttcctagccattttcgcataatatttgttgcgcctgaaatttcagagaaacggttaaagagaatcgcaccaaaaattactgtaataggtgtttgtaccgcaataattgcagaaacaacatttgcactaatagtgacaatatctgtattaaagtgtaaaagatgaacacccataactaatgtcgcaatccaaggtaaggcaacataagaaggtagcgcgtttctttttaccataagataaatcagtaaaacgataggaaaaatacttagaataaaagacagcataaaatatcctcagagttagattaaaagatgtgattattttatggatttatatgcaaaagcatatacctattttaagaaaatgtgatcaatatctcataaaatttaacattttgttttcattttttacatttttattactatttgtgtttagttatagcattaatagaagaatatggaatatgataaagattgtttaataccatattaacattagcaggatcaccaaattctcactataatgcgcaaaattttgagaatgaaaggataatttgtatgggaatgattattactgttgatggtcctagtggtgctgggaaagggacgctttgttatgcgttggctgaaaagttgggctatgctttttattgataaaaatctccccttttaatcgaggagatttttattattcttctttaaattcttccatcatttcttgtgctttttttaccatatcttctgaaccaacaaaaagtggaacacgttcatgaagtgcggttggttcgatatctaaaattcgacgataaccatctgttgcgacaccgccagcttgctccgctaaaaatgcaataggattgccttcatataataaacggagttttccatttggatagttggttgcacttggataaatataaatgccgccttttaataagttgcggtggaagtctgctacaagtgaaccaatatagcgagatacgtaagggcgatgagtcgctttatcttcttcttggcaatatttaatatattttttcacaccttgtgggaatttcaggtattgtccttcattgatggaataaattttgccctcttttggcatttgcatattttcgtgggaaagacagaatgtaccgatagacggatcataagtgaaaccattcacaccgtgaccagtggtataaaccaacattgttgatgaaccataaacaatataacccgaggcaacttgtttattacctggttgcataaaatcttctaaggtaacaggtgagccaataggggatacacgacggtaaatggagaaaattgtaccgacggatacgtttacatcaatatttgaagagccatcaaggggatccgttaaaataatatattttgcattacgaccacgttccgtatcaaatgcgataaaactttcctcttcttcagatgcaaacccagccacttcttcacgtgccattaatgccgctttcatcgtgttatgggcgaataaatcgagtttcatttgactttcgccttgtacattttcaataccagattgaccgagaatatttgttaaacctgctttgttaatatctcgatgaattattttcgctaaaagacgaattgacgacaaaataccactcaattcccctttagcatttgggtattctgcttggcgttcaacgataaattcacttaatgttttcataattttccttttagtttttcataatacattgattaattatagggagtttggagtgtaaactctaatggcagattatcagaatgggatctttatcacaaaaaattcacattaattgttgtaatttttagaagctatcacttatttgttaattaattctggagtgattttgtgaatttgcgctccaaataaacttgggctaccataaccgcactttattaagccaaaaggtaaaaaatgaaaattgcattaggcattgagtataacgggcaaaattattatggttggcagagacaagaaaaagtccgtagtgtacaagaagaattagaaaaggcactttctcacattgcaaatgaaaaaattgagatattttgtgcaggcagaacggattctggcgtaagtggaacgggtcaggttgttcattttgaaaccaatgcggttcgtccagagaaggcttgggcttttggtacgaatgctcatttacctgatgacattgcggtggcttgggcaaaacaagtcgatgatgaatttcacgccagattttccgcaacagcacgccgttaccgctatattctttattgtaataaattacgctctgcgattttagcgggaggaataacccattgccatttagatttagatgcggaaaaaatgcatcaggcagggcaatgtttacttggcgaacaggatttttcctctttccgtgcggcacaatgtcagtctcatacgccttggcgtaatgtgcatcatttgaatgtgtctcgtatcggaaaatatattattgttgatattcaggcgaacgcttttgtgcatcatatggtgcgcaatattgtgggaagtttgattgaggtcggtgctggaaatcagccgattgaatggatgcaatggctacttgagcagaaaaatcgtcagcttgctgcaccaacagcaaaaccagatggattgtatttggttgatgtgatttatccacaaaagtttgatattcctaaacgcccgattggtcctttatttttagaggatggtttattaaatcgtactttgaagtaaagcgtaatttcatgttttaaataaccatatctgaaaatattcttcataaaaaaagaccgcactttaaaagtgcggtcaatcttaagtgagttttatattaattttgatattccataattcactaaaaatccaccaaccattagccataaataaattagtgttcctaaaacaagtggttttaatcctgcctttttgattgcgcttgcttgtgtcgttaagccaagggcagccatcgctgaaattaataagaaagaatcgatttcaactaataatttcacgagttcttttggtaataaatcaaaagaattaaaaatcgcaacgccaataaaaagtacagcaaaccaaggaattgtaattttgtgtgatgtattttctgatactccattactacgtgttaataaccaagaaagcattaataaaaatggtgcgagcatcatcactcggatcattttggaaatgacggcagtattcgccacgataggatcaatattttccccaatcgcatacacttgagccacttcgtgtacactagaaccaacataaataccgaattgatgggcgttaattaaatcttgtgaccacgtgtagaacaaggggtaagtaaaaatagcaagcgtcccgaaaatgaccactacggcaatcgctactgaaactttatgagattctgctttggtaacaggctctgccgccataaccgctgccgcaccacaaatactacatccagccccagtgagataaaccaattgtttatccatttttagataacgaatgcccaaaagtgcggtaagaaaaaaggttgaaattagcataatcgcatcagtgacaacagcatttaagccaacatcggcaatatcgccaaaagtaaggcgaaaaccatacagcacaatgccagtgcgaagaagcgtgcctttcgcaaataacacgcctttttccacttgtgttgaaaattgcggataaatggtattgccgattgccattcccagcaagatggcaataattagagcactgatatgataatgatgggaaaaatcagtgtttcctaaatagtgagcaagtatagcgataatcgcaataaatataagtccgaaataaaagggacgagtgttcatttttcctttccttagtgagtgtttttgtcttttacccaagcggtttcatctaaaattttgccaaaatagctttcgactaagcgacgagtaacatcagtttgtggatcagtaaaaagattttgagggctgccatattcaatcatttttccgtcatccattacgataatcgtatctgcaatatgtttaattacaccgagatcctgtcccacataaatataagatatacctaaacgttgttgtaaatcaagggttaaattaagcaattgaatacgtacagaagcatctaaattgccaattgcatcatctattataataatttctggtgctaaaattaatgcgcgtgctagggcaacccgctgcttttggctgatagagagatgcttaatattgagatttgtgtaatcaggataaagtccaacaagagagagggtctcaaagattttttcattacgttgtgtttctgtccaatctgtcgctaggcttaatggttcgtctaatatttgtccaatatttaaacgtggattaaatgcagagttggcatcttggaaaaccatacgaatatgtttagctctagattgggcatcctgatattgtaattctcgatcattaaataaaattcgaccagaagttggcggaataatgcccgctatcattttcactagagttgatttaccagagccattattgccaatgattgcaagtgtttgtttacgttcaagggtaaaactcactttatccactgcattgaattgatttcgaccaaataaactggcgtgacctttaaaagttttagttaaatcttccacttgtaataagggcattattcatttcctttgcaattaagtataaaaggggtggcggttgttttttctttgaaatttttttctcgtaaattaataggataatgacaagaaaattcgtgttgttttattttcaatcgtcttggtttttccatacattttttttgtgcaaaagggcatcttgggccaagacgacagccaattggcatttgctctaaaataggcgcggtgccttctaacgtacccaatttagttttaaaccccaaaggttgagtaaaatcgggtactgcattaattaaggcttgggtataaggatgatggggactttcgattaatatttcagtcggggcagattcggtattttgcccacaataaagcactgaaatttgatcgcaccattcactaatacttttaatatcgttactcgtaagtaaaattgttgttccctgattttggttcatactggaaagtaaacgaaaaacttgtagggcagtggttgattctaatgtatttgttggttcatctgcgattaataaacgtggctgattagcgacagccattgcgatcataactttttgtccttcgccttctgtcagttcgttaggatagcttgccataatatcacgatgatctttaattcctacgcgatgtaacaattcaatagcacgtctttttttccacccaaaccatttccaccatttatttttaaatgtccaattaggaatattttggatgagttgtttccctatttttcgacttggatcaaggcaagataagggattttggaaaatcatggatatttctttgccgacaatcttacgtcgtttattaggactgagttttagtaattcgatatcgtgaaaacgaaagcgatcggcagtaataatccaattttctttgattgcattacaaatgactttagcgattaagctttttcctgagcctgattcgccaactaatccactgatttccccttcgttaagggaaagattgacgccatctacaatttttatacgtccattggaggtttgaatttcaatattgaggttacaaatgtctaaaagtgccataggctattcttgatgttgattgatggctttagttaagccattactgaaaataatacttaataaaatagtaaaaataatagcgaaaccgggtaaaagtactgtccaaggtgcaagataaagtagttccaaagagtcttttatcattgccccccattctggtgtaggtcgttgtgcaccaagagaaataaaacttaatgcgctaatatccaacacggctataacaaaagcatgagccacttcttgaatataaataacagtaatattcggtaaaatagtgctttttaataaggtttgattggaaatgccttcaagttttagcattacaacataatccttttctaattctttttgaatagcgcgatagatagtgtgaatgaaataaggcaaaattgctaatagcgtagcaaacattgcattccataaacttggttccattaatgttgaaataacaacggcaattaatagaataggtaacgataaaaaagcatcaaaaatatgcccgacaaaacgagctttaatacctttcagtagtcctgcaataattcctagtgcgccgcctattattgccactgaaaagacaaccagtaaagcagaacctaaggtataacgagtacccataattaaacgacttaatatgtcgcgacctaaatcatcagtaccaaagaaaaaagcaatttttcctctatctacccaagaaggaggcattaattcttgcccaataaattgtcgattatcagcataaggtgcaagataactagcaaaaagtgcggtaaaaattaatgcgattaataaataaaagctaaaaagtgcgatggtattttgacgaaagcgtaaccaaatttgaaagattgaggtgctttcgcggaattcatcaggttctttatcttgcataccaacctttctttttaaatggatcgagtataaaagtgaatattttagtgaatgtatcaatcaaaataatacatacaccaataacaattacacctgcggcaatgctgttgtaatcttgttcatttacggcattaattaaccaacgaccaatgccaggccaacctaaagccgtttctaccaacatacattgcgttaatactaatgtgaatacacgtggtacttgtggaacaagcaggggaaaagtattacggaatacatattgatggagaattttccattttgaccaaccccgtgttgtcgctactttagaaaaattttgattcaaaatatattctgctcgttgatgaataatacggataatttccattgttggcaaaatacacaataccaatgttggtaaggctaaatgttgcaatatgttttgtacgatttttgtacgataaggtacttccataaaccacatatcaataacaggaaatcccgtaatgggtttaatttcgtaaagcaaattatattgtccaatagcggcaatttcccaatgtgagagcgcggcaacatacagtaaaatgggggctaaccaaaatattggaatagatagccctacataagataggatttgtaaactttttgcaaaaacttgttcagaattgaccgcacttataatgccaagtggcaaaccaaaaataaatgccaaaaacaatgtaatgaaacaaagttccaatgtgggaggaagaaccgtaagaataaggttcattaatgattttccaccgttataggtaatgccaaaatcaccttgtaacaaggtgcctaaataatggaaatagccgatataaatgttttgtgtaacaagattcgcattaagaggatcgcgcaataaaataacaaagcctaatagcgataatacgagtaataataatgccacccacagaatatggcgaagaaccgaccagaacattagtgtttctcctgaataaaatataaggtggaaaaatctaagctaccaaaaggcgtcatttttactcctttcacacgactatttgcgactaaaattcgttttacattggcaataggaataatgggtaattcacgtaaaacgagttcttgggcttcattataggcttttgcgcgtgaacttaaatgtgaggtggtaatggcacgatccataaattgatcaaattcttcattacaccaattagataaattagtgagttcattttttgttccacagcttaaaattggacgcataaaaccatcaggatcaagattaccagctaaccaaccagatagaatcaaatcataattttccgattgattgcgtaattgtgcagttaaaaatggacgagttacggcacgcactttaactttcacacccgcttgagctaaatcccatttgatcatttcagccattttaaaaggtgctggattatagacttgttcttcattaattacccataaatttaacaaaaggtttttatctgctaatttatttttggcgattttgggatggtaatcaaactcaaattctggcgtattgacagttgaagcccaagacacttcaggaataatgttattagcaacagttgctgtgttatggtaaatgctatgaatgattcgagctcggtttaaactttgtgaaatagcagcacggatttcgtgatctcgcattaatggcttatcaaaattaaacgctaaataggctaaattcataccatcagtagattgcatataataatgtttgtcatcattttttaataagccaatttggcttacttcaggataagaggcgatttgacattcattattgaaaaatttgactaaacgtccgctgcgatcagtagaaagatccacaataatatgttctatcttggcttcttttttccaatagttttcgttacgcactaagcgaacatattggttatatacataatcttttacttgataaggccctgtgcctactgggtgggtatctaattgagcaaggttgtcatctgcgcttaattgataggcatattcttgtgaaaaaataatggcatactggctggcaagatgcgacaaaatggaggaatctggtgcaaataattcaatttttacttgataaggcgaaagtgcggtcacagatttgattttttcgttaagtttaatgctatcaaaataaggaaaacgcacttttcttgcttgttcgtgaaacactctatattgtggattactataggtaacattcgcctctgctaaggttggtaaataagtattatgccctaatacacgattaatcgaaaatactacgtcttcagcgttaaaatcacgtgttggggtaaaccaaggggtttggtgaaattttacgccgtgacgtaaatttaataaaatttctttaccatcagctgaaatggaataagattgtgccagcattggtgttaatgttgcactgtgattttttatatcaaataatttgttataaatttgttccgtgaccacattcatactggttcctgcatctgctgtttgcggattaaatgaaaaacctgaagcgtgggtgcaataagttaagccattttcagttaaaaatgttggaacacttggcgcagcctgtaattctacactttggcttatacagagcagaaaagataaaaatctcagatttagacgtaacataacaaatgcattgtgataaattatgtgtcaaattgtaaggcatattagtaaaaatggctaggatattgaatgtttaatcgggttcaaaaggaaatcaatcaaattattaatcgtggttttgatcgcactttgcgtttagcggtaacagggttaagtcggagtggaaaaacggcgtttattacaagtttaatcaatcaacttctctccattaatcaacattcatcacagaatttgcccttgtttgaagcagcgagaaatggtgcgatcttggcagtcaaacgagtatcccaacaagatctcagcgtgccacgttttgattatgaaagtaatttaaatgatttgtcacaaaatccgcctcaatggtttcaatctactcgtggcgtgagtgaaacgcgtttagccattcgttttcaacgccaatctggcttgctacgccatttgaaagaacgaggcacgctttatctagatatttttgattatccaggggaatggctgatcgatttgccgttattaaatctagattttcaacaatggtcacaagagcaaattaaggtaacaacaggcattcgtgaagaattggcggagaattggctcgctatgttgcaggatttggatttaagtgcggtcgcaaatgaagatgttttagccaagatagcgaaaagttatacggattatttacatcaatgcaaagtgcaaggcatgcaatttattcagcctgggcgatttgtattgccgagtgatttagagggcacgcccgcattacaatttttcccattaattcatctttcagaagaacagtggcgaaccttgaaaaaaacagcaaaatcaaatagctattttgctgtgctgacaaaacgttatgattattatcgcaataaaattgtgaaaggtttttacgaaaattatttttctacctttgatcgtcaagttattttggcggattgtttaacgcctttaaatcacagtcagcaagcctttttagatatgcaaatgggcttaaatcagttatttaataatttccattatggcagcagaaattttcttcatcgtttgttttctccgcgaattgatcgattaatgtttgttgcgacaaaggcggatcatattactcgtgatcaaattcctaatttagtaagtttaatgcgccaaattgtgcaagagggtggtcgccatgtggaatttgaaggaatcgatacggaatataccgccattgcggctgttcgtaccacaaagcaagtgattgtgaatcagcaaggaaaagaaattaaagcaattcaaggggttcgttctattgataaacagctgattacactttatccgggaacggtgccgagcaaattaccaagagcagaattttggcaaaaacaaccgcactttgattttgatagttttgaacctcagcctttagaacaaggggagagcattcctcatttgagaatggatgcggttttacaatttttattaagtgatcgatttgaataaaaagtgcggaaaattttccgcacttttttcatctttctagcctgtattgcgcatcccagccgcgatacctgtgatggtaatcatcaatgcttgttccacatcgggattgacttgctctggattttcacggaaacggtgaagcaattccacttgcagtagattgagtggatccgtgtagatattacgtaatgcaattgaatctgcaatccaaggtaaatcagacatcaattcactttggtgagaaagtgaaagcacagtttgaatatcatcttcaagttgcttacgtaaattttcacctaaataccaaagctctttttcactaatcgttgatcatattgtgggaaagccaagtatccgatttactaaataccatttccaacattccgattcgcgttgaaaagacggccagttttcgcacattttatgaataatatcgcctttgccttgttcaatacttgacgaatagctgcaccagcccctaaccaagctggcagcattaacgttttgcatccaggcaaaaatccacgggatcgcacgtaaactttccacaccgccatttggattgcgttttgcagggcgagagccaagcggcaatttggagagttcctgttctggcgtcgcactgcggaaataaggcacaaaatctttatcgccacgcaccacaccacgataaatatcgcaagaaatcgtggaaagctcgtccattatagtacgccattctggtttcggttctggtggtggtaaaagatttgcttctaaaatggcgctggcgtagagatcaaaggtttctactgctactgcgggtaaacccagtttgaaacgaatcatttcgccttgttctgttacacgtaaaccattttttaatgaacgaggtggctgagaaagtaatgccgcatgtgctggcgcaccgccacgaccaattgtgccaccacgtccgtggaataaagtgagttcaatgccaagtttttctgttaaatttactaaggcttcttgcgcacggtattgcgcccaagaagcagccatcattcccgcatcttttgccgaatctgaatagccaatcattaccatttgacgattattgatcacgccacgataccaacccacattgaaaagttgagtcatcactttttcggctgcatctaaatcctctaaggtttcgaataatggcacaacaggaatatgatatggcacgccagcttcttttaagagtaaatgaacggctaaaacatcagatgcactgcgcgccatcgaaataacataacacgcaatgacaccttgtttttgttgagcaatgactttacaagtatctaaaatttctttggtttcaggcgatggcgtccagttttgcggaatcaatggacggcgagagcttaattcacgaattaagaaagcctgtttatcgtcttccatccattgagagtaatcgcccaaaccaatatagcgcatgatttcagcaatggcatcggtgtgacgagtgctttcttggcgaatatccatttgagaaagcgtcacaccaaaacaactaatacggtgcaaaatatccaacaatgaaccatttgcaataatgcgcataccacattgaattaaagattgataacaatcgtaaagcggctcccacagttgattatcttccaaaataatctcgctttcggagactcttggtgtgcgattagataagtgatcatcaaaataagctaatgttgctgtaagttgattgcgtaaattttttactacgaaacgatagggttctaaatgttcgccgtatttatcacgaaattcatcgctacatttcatcattgaaagttcatcggctaatttgctgatgtcttgtaagaataaatccgccgctttccagcgggcaaaataaagtacttttttggtaatttgtgcggtaacaaatggatttccatcacggtcgccgcccatccaagaggaaatacgcacaggttttaatcctaccggcaaatcgtaacctaaaaattcacgggcggtttcgttgagttggcgtaaaaattctggcacagcttgccacaaactgttttctaacatcgcaaagccccatttagcctcatcaaatggcgttgggcgaacagtacgaatttcgttggtatgccatgcttcagcgattaaacgaagtaatagacgttcaataatattgcgttctttttccgttaaatcatgatgttctagcttgcttaaacatttattgatttcaatgtgtttatgaattaatgaacgacgtgttgtttctgttggatgtgcggtcagaacaagctcaattaataatttttcgacggttttatgcacctcttccactgaagcattttgttcttttaagcgtttgaaaagttcgcttaaggattgagaagaactttgtgcaagagaatgttcacgggaaatggtttgatattgttctgctatgttagtgaggtttaaaaattgactgaaagcacgtgcgacgggaataatattttcattagaaatactaccgagcgtatcgagcaatgcttgtcttgctttatcatcgccagcacgagaattacgagaaagtttacgaatgttttcgattaactcgagaatatcctcgccctgtgcatcattgatggtttctccgagaaaacgccctaacatactaatgttattgcgcagagtactgtactcttgtgtcataggaactcctaaaagtaaaaaataaaatttgtcagttggcgatagatataactaaaaatagggtggagggcaaatgctattcagagaaattttgaaaataatcaagaaaagctaaaaaatagctaaaaaagaaccgcactttttagggattatttaaaaagtgcggtctatttttgctaagtttataaaatcgatttaacggattttcgaatgataagctcaggggttatatcgatacgactatattgttgaacaccttcatctttgtgagtaattcgttctaatagaatatttactgcctgtctgcctaaacgtagttttgattgatgaatggtggttaatggtggtgcgtagaaacgtgaggcgtgaatatcatcatagccgataattgacatatcctctggcacacgcaagcctttttctgttagtgctgatattgcaccgagtgccatcacatcgttacagcagaatagggcggttggtaattcctcttgagtcagtaaacgattcatacattcatagccatcttcaggctcaaatgcaccctctagtacccaagacggattgattgttaatttagcttcttccattgctttttcaaagccttcataacgcgttcttgcggtagttttattgagttcgccgcagataatcccgatttttttatgaccgcactctataagatgtttggttgctaaataaccgccatcaaaactatgatcatcaatcacatcggtattcgcatttgggccccaatccattacaaccattggaatagtggaaaatgatgaaagtaaatccaatgaatcctgagtatattcagaacacattacaagcaaaccatcgacccttttttttgccaacatttctaaatgatttttgactttttcaggatcattttgtgtgttacacaaaaataaagaataaccttgtcgatagcaatgttcttcaacagaatggattatttcggcaaaatacggtgcttcactggttgtcacaatcataccaatggatttggtggtattgacttttaaactgcgtgccacagcactaggggaataattaagttgtttaattgcggataacaccgcttcttccgtatcttttgcaacgaaacgggttttattaattacgtgagatacggttgtggtggacacaccagccatttttgccacatctttaattgttgccatatatttaaatccctaaaaaatttttcctattataaaggtttgttgagaatttagtcatctttattgcaaattttttataaaaagaagtgattttttcgtattattcttgctagaatgtctgcgttattttttttatgaggagaacaaaatgagcgattttggttatgcaatgattatggttgtttttagtatgtctgttgtcgtggggcttgcactttcaatcttttaatcaaatcaactttttattatcaccgcagttttgtttctacaaagtgcggtgattttttttcggtgttttgcttgcccgtttaaaatatggtaaaactaatgccgttttattcacaacatatataggaagttctatgtcaaatttacaagcaattattgaagctgcatttgaaaaacgtgcagaaattacaccaaaaaccgttgatgcagaaacgcatgcggcaattgaagaagtgatcgaaggattagattctggaaaatatcgtgtagccgaaaaaattgctggcgaatgggtaacacatcaatggttaaaaaaagcggtattgctatctttccgcattaacgataaccaaatcattgacggcgcagaaacaaaatattacgacaaagtggcattaaaatttgcggattacactgaagaacgttttactgaagaaggtttccgtgttgtgccttctgcaacggtgcgtaaaggcgcatatatttctaaaaactgcgtattaatgccatcttatgtaaacattggtgcttacgttggcgaaggcaccatggtagatacttgggcgacggtaggttcatgcgcacaaattggtaaaaacgtgcatttatcgggtggtgtaggcatcggcggcgtgttagaaccattacaagctaacccaaccattatcggcgataactgttttattggcgcgcgttcagaagtggttgagggtgttatcgttgaagatggttgtgttatttcaatgggcgtattcattggtcaatcaaccaaaatttatgatcgtgaaacaggcgaaattcattacggccgtgtaccagcaggttctgtggtggtatcaggtagccttccatcaaaatgtggaaaatatagcctatattgtgccgtgatcgtgaaaaaagtggatgcaaaaactttaggaaaagtgggcatcaatgaattattacgttctattgaagaatagtaaaaaatataaaaaaagaccgcacttttaaagtgcggtctgaaaatcaaaagaaattaagcagcgaacggatcacgtaaaatcattgtttctacacgatcagggccagttgaaagaatatcaataggtacgccagttacttcttcaatacgtttaatatagttaatgcagttttgtggcaatttatttacatctgtgatgcggaaagtattttctttccaacctggtaatgtttcataaattggttctacaccttcccaatctttcgccgctaacggtgcatattcaacgatttcgccatttggcattttgtaagcaacacagatttttacttcatcaaaaccatctaatacgtctagtttagtcatacagaaaccagaaatagagttaagttggattgcacgacgaatggcgacggcatcgaaccaaccgcaacgacgtggacggcctgttaccgcaccaaattcgttacctttacgtgcaatttcagcacctacatcatcaaataattcagttgtgaatgggccaccacctacacgagtacagtaagccttaatgataccaagtacataatcaagattacgcgggccaaaaccagagcctgttgcaacaccaccagccgttgtgtttgagctggttacatacggataagtaccgtggtcgatatctaacattgtcccttgtgcgccttcaaataaaatatgttcgccatttttgcgcgcagtatcaagaattgtagtgatatctgccaccatacctgtgattacatcggcaattgccattacatcatctaaggttttttgataatcgacaggttcaactttgtagtagttcaccaattggaaattatagtattcaaggatgtttttgagtttttcggcaaaggcttctttattaaataaatcgcctacgcgtaaaccacgacgagctactttatcttcataagctgggccaataccacgaccagttgtacctatagcttttttgccaagggctgcttcgcgtgcgtgatccattgcaacgtgataaggcagaatcaaaggacaagcttctgaaattaataaacgttcacgaactttaatacctcggctttcaagttcgcccatttctttcattaatgcttcaggcgaaaccacaacgccattaccaattaagcaagttacgtttggatgtaacataccagatggaattaaacgtaatacggttttttcgccattgataataagtgtgtgacctgcgttatggccgccttgataacgaactacgtattttacgcgatccgtcaaaagatcaacgatttttcctttaccttcatcgccccattgtgcgcctaagataacaacgctttttcccataatttccgccttttattcggttaaattagtcaaatgaacagccgtttactttactctttttcggctttaatctcaatgatataaaagaaaaagtgtggtgatttttcaccgcactttaggtttaaattttattcaaataaggatttgtgtaacgagcgtacaatttcatcagaatgttcactttgtactaacatacaaacattgttggtacttgccccataactaatcattcgcacattataagattgaacagtatcaaaaatacgttttgccacacctgaagtgatatgcagatcattgccaattaatttttcacgttctgtcgcttttacaccatttactaaagccactaataaatttgttacaccagctgatgcagaaagcacaactacgcgtgtattgggatcggcaatgacaatttttgcacaagctgtcatcgcattgtagttagcaacagatgttccgccaaatttggcgactgagagatggggcataagatactcctagatgttgtgttttttttagaatagtgggtatagaaataacgatttaggcattttttgtcaaataaattttaattaacaataaatgaacgcataaaagaaaaaataggattaggaaaaatttggctgttgagaaagccatataagttgtttaaatgaataaaaaataagtgatatgcttcattaataaccaaacaaacataaaattactttttttgtaaaaaagtatttgacgaggatcatcaaaattagcataatacgccccgcaaagccgatatggttaagcaaattaagtgatggctacatagctcagttggttagagcacaacactcataatgttggggtcgcaagttcgaatctcgctgtagccaccaaatttgcgggactggcgaaattggtagacgcaccagatttaggttctggcgccgagaggtgtgtgggttcaagtccctcgtcccgcaccatttatcgctttgtaattcaaatagtcgttggggtatcgccaagcggtaaggcactgggttttgatctcagcattcctaggttcgaatcctagtaccccagccatactatcaaaaaagtcttctttatatctaatcaaagatttatctaattggggtatcgccaagcggtaaggcactgggttttgatctcagcattcctaggttcgaatcctagtaccccagccatattttcaatatcttcgtaataacttgcaaaaatcgttatttgataaaaaattaaagtttaggtatttattgggaaataattaaaatactcagaacaaaaaagctaagattgatctcttagcttttttactttgttcaaacttgtgaattacgcgcgtttgaagtcaatgtgaaccaattttggtttgaatgggtgacgttgcattgcttgtactttaactgcaacttctttaccaccgatcactaaagtaatcacttcagaatagaaagattcgtgtgcttgcgcgttgtttaattcatcgtggtttaagatgattgaaacgggctcttcgctgccaccataaacgattgcagggatttgaccattgttacgcaggcggcggctcgcacccttaccttgcgctgtacgaacttcagcgttaaatttaaatgccatttttatgttctcttgaaattaaatgttaaaagaaagaaaatcgcaggcgacccagcaattttcctaaaaaccgctcaaagacaagccttgagagccgtggattatagaatatccttattttcaaatcaaacttttttctaggctttttgatttgaaaagattaaaatgtgaaccaattttttatcacatctattaatataataaaaaagcaggaacaaatggaatttttaattggattttttactgaatatggttattgggctgttctttttgttttaattatttgtggatttggtgtgccgattccagaagatatcacgttagtttctggcggtgtcattgcggggctttatccagaaaatgtcaattctcatttgatgttgctggttagtatgattggtgtgcttgctggcgattcctgtatgtattggcttggtcgaatttatggcacgaaaattttacgtttccgaccaatacgtagaatcgtaacattacagcgtttaagaattgtgcgtgaaaaattcagtcaatatggcaatcgagtactgtttgttgcacgatttttacccggtttacgtgctccaatttatatggtatcaggtattacacgccgtgtaagttatgttcgttttgttttaatagatttctgtgctgcgattatttctgtacctatttggatttatcttggggaattgggggctaaaaatttagattggctacatacacaaattcaaaaaggtcaaattgtgatttatatatttgttgggttacttgtactattctttttttggaaatggaaaaaatctaaaaaatcaacgcaataatagaataataaacggctaaaaatatttctatttttagccgcactttttaattttcttctttattttcttctttattttctttaaataagcctgatgcaccatccgaataatctctaggctgttcattttgagatttatctgttgcagtaattaactgttgggtgaataaacctttgtgatctttttcgcccagtaaattattggaggaagttgcgtagtggcgataaagtttttgataatcgttaattaaggttttgaataactcagcactttctgcaaaatgtttttcgatttgcgccttttgtgtatcaagctgggttttgactgtttttaattcagcctctgttttagcttgatgttttaccgagcctttggttaaacgcacaataatgtaaccaataaataacccaacaataaaagcgataccaattgctacccaaatttcatttgtccaattttccataatattctcctgtttattcggcttaaaaaactaacaagttgcaataataacaatttcaactttccaacgaggatccgctaatttagcttccactgtcgctcgacttggtgggctaacatgatcgacccattcatcccaagcttgatttaattgaacataatcttgcatatctgccaagaaaatttgcgcagttaaaatattgcttttattggagccaatttctgctaacaatttatcaattaaacctaatacttctttggtttgttcgtaggtattttgctcgatggttaattctggaacttgccctgcaaaataggcgaggttgttatgaattgaaacttcacttaaacgtgcattgggtaaaatgcgttgaattgtcatagggttctcctttggggtgttttcttctattctaaatagcctttactgctttgtaaaatcctctttactaggctaaaatatccgacaattattctcaattatttaattattatgaaactgcttatctctaatcagcacggtgctattgttatggcactactgccttttatttatggtatgttgcttgctaatccagtatgggcgcacatgtttttattattaggatggttttcgctttatttgatgacttatccttttttgaatttgtttaaaggtaaaaatcttgagttatataaaaaatggtctgtgatttattttgctgccgccgtgatttttgcgattcccgcgttaatttataattggcaggtgttgtattttatgtttgccatgttaccgtttgttgcggtgaatatttatttcaccaagaaaaaagatgagcgcaatttatggaatgacttggcagggatcttaatttttgccctagctggaatgggatcctattacttttctgaccgcacttttgatgaaaaaatactttgggtggcgatttatccaacattattttttattggaacaacactttatgtaaaatcaatgatgcgtgaacgaaaaaatccacgttatttttgggcatcagtgatttttcacttattatgtgtgctgatttttgtggtttcgcaacaatttattttagcattagcttttgtgcctggattagtgcgagcggtttatctgcccactaaaaagctttctgttatgcaagttggactaacagaatttgcgattactgccgtattttttattttacttttagtagcaaccttgtaaatgaaactgaagttattttttcatatagtattactttgttttagtttgcctgtttgggcgatgaaaaccattgatattacagcgaattcgaaaatggatgatcaagcaagaatgaatttggcgcaagagtttgccaataaacagcaatggagctctgttttcgatatcatgtatccgatggcgttagagggaaacaccactgctcaaagcaatctaggtatgttatataaccttgggcgtggcacggtgagagactatgaaaaggcttattggtggtttagcgaagcggcagagaagggtagtgtgaaagggctaaataaccttggcgttatgtatctacgtggcgattacgtcaaacaaaatacagagcaagccattaagcttttgaacgtacagctcgagctaaagatacggatgcgatgatgatgttaagtaatatttatcgcttacaaaaccaacctgaaaaatcattggaatggctgaaaaaagcagctgaattaggcaataaggaagcaaaacagcgtttatctagtcagccataatcttaaaagtgcggctattttaatcgcacaaatttcacgccactatgttgcaatagcaatttcattggatcttcatcattcgagactgttttttcacgtaattcaattaatttcatccgtaaatgggcgagttcgtgaatccttgttgccacctctttaatgtgtttatctaacacacgattaatttcttctgcttgttgtttggaggcattttctaaattcagtaggctttttatttcacttaatgaaatatctaaatttcggcagttacaaataaatgataaacgttgcaagtgttcttcattatattgccgaaaattgcctaaagtacgttttgggggcgggattaaaccttgttgttcataataacggatggtttctacggtacagcctagggctttagcaagtgctccaattttcatcaatttccttaaaaaatgacttgattctaaagttacttcatattttatcatacgcctagattttcttaaacaaacaaggagtatccaaaatggaattgaaaaaaatcgctgtaggattaaccgcacttttaggtatgtctgttgctaacgcacataatgtttggcttgagcctgcttcatcgcaagatgaatacgtagtgaaatttggacatgaacaaactgaaacctatccagaatctaaacttaaatctatccaagccttaaatgcgcaaggcaaattaactgctgttgattaccaattcagaaatggcgaagcctatcttatgcctaaatcagatttagttttcgttcatttcgataatggtgtatggtcaaaattaccaagcggtaaatacgttgaaaaaacaaaacgtgaagaaccaacagcagaatttagtactaatcctgttaaatttggtaaagcgattttgaaatgggatgctgaatctttcaaatctcatcaacaagcatacgaattgattcctcaagaaaaagcacaagcgaataaaccactttctatccttgttttacataatggtaaaccagttcaaggcattaaagtgggtgtgagtgaagatgcaccgttcaatttaactaatgaaaaaggtatcgctcaatttaccccaactaaaggcttcaacaaagtatgggcagagtttgaggaaaaagtaacaaataatgcagattacgatcgtcgaactgtggaatatatgctaacttttgatgcgcaataatatggatttgggatgaaaaaatttgcttttttaaccgcactttttgcggcttgctatctcccgaatgcttatgcccacgcgctttatgtgtttgcccaatatgatgggcaaacactttctggcaaatcctattattctgatatgaccccagcagctgaaacttatttagaagttttccgctcaggtgtttctgatcccgttttaactggaaaaacagaccgccaaggtgcatttaagctttctattgctgatgtaccacatacaaccttaaaagttgtggtggaaggcgatgaaggacaccgtgcgtccgttgttgctgctgctcatacgtctgccgaaaatcaaagcagtgcagatttaatgctgcttcgtgaagatattgcgcatttaaaagataaaatttatttgcatgatattttaggtggaatcggttatatcgttggtattgctggacttattgctttacgtaatgcgcgtaaaattaaacaaggacgtatttaatgcatttatctgaaggcgtgttacatacgcctattttattagctggtgcagtgcttgctgttgcgggcattgctgtgggggtacgtcgtttagaatcagaacgtttaccgctcaccgcactttttgccgctgcattttttgtggcaggaaccattcatgtgcctgtaggaattggtagcgtgcatttaattttaaatggcatggctggtttatttcttgggtgggccgtttttccagcattcctcatcgcacttttattgcaagtcattttcttttcttttggtggatttgccgtgttaggtgtcaatctttgcgtgatggcaataccagctgtgatcgcttattatcttttccgttctcgtttacagccacaaatggcattaaaagatcgcttattagtcggtattggtgctggcgtaattggcgttggcggagcaggcgtgcttgcttcttttgtgctgatgttagatggtggtaaaagttatctgaatcttgtttggctcttgctagtctctcatattccagtatttgttttggatagtattatcagcgtaggggtgattaccttgcttggtaaaatgtatcctgaagtcatgaatcgtaccgagaatttctcttaatgaaaattcatcgcttatttcaaccgcactttaggttgatttatctgtttatctgggggctaatcattagtggattgagtgatcttacttggcttatctcccttaatgtgcttgcagtttctctcttttttatttcactgcagctcagtcaaaaatcttttttgccttatcttaaacgttggtttgctttagtcatttttattgctttaatgtgggcggcattaagttggcaaattggagaaaatggcattgaactcaattttcaaggcattgaattagcagaaaaattgagtttgcggactcatttattgttgatttctctttggctttttttgtggaatattaatgatgcagtacttgttcaagccattggtaaattgcctttgccagaaaaattaattcaactttttgtgctgaccgtacgttacattgcactgcttggcgaactgcgtcaaaaaatggatattgccatgcgagctcgtggatttcgtcctgggcttaatcgccgaaccctttatgtgacggctcaaagtgtcgctttattattgatccatgccctattaaaagccgaaacggcgcaaatggcgttaaaatgtcgtggttttcagtttggcaaaaagagagaaaaataatatgttagctgtaaataatctttgtatagaacgcaatggtagagcgattattcaagatttgagttttaccttggaaggtcaaaaacgcctcttcgtacaaggggaaattggttcaggaaaaaccactttactgcttgctttgttgggatttgttcctgtaaccaaaggggaaattaaattatttggcaaagtttgtcgtgaagaaaaagattttgcgccctttcgtggcacgattggtatttgttttcaaaatgccgatgatcaactttttggcccaacagtgttggatgatgttgccttcgggccattaaaccaaaatatgcccagagagcaggcgtatcatatcgcagagcagcaattagaacgtcttggtatcacaggtttaaaagatcgtatggtgcataccctatctggtggtgagaaaaatttcacggcacttgctggtgtcttagcgatgcagccaaaaattttattattagatgaacccaccaatggattagatcgaaaaaatactgaaaaattgaccgcacttttgcgtgagctttccttacccatgttgatttcatcccatcatcatggatttattaacgaattagccacagaaattattagatttaccaacaaatgaaccattgccgagaatttgttaatgattaaataaaattaaagccttgataatcaaggctttattttttacttacaatattttagaggatatattatttctaaccctattaaagcactttcacaatgctttcacataaatagcgaatattatcttcagtaataccagccacattgatacgaccagaacgaacagcataaatggcaaattcttcttttaagcgatccacttgttccccagttaatccactgaaagagaacataccgttttgttcaatgataaagctgaaatcttgttccgcaccgtattcttttaataactgaacgaataaatgacgcatttttttgatacgttcgcgcatttcagttaattcattttcccactcttggcgaagttgagtgtcatttaatactgttgctacagttgcgccgccgtgagatgcagggttagagtagagtgtacgaataattgatttcacttgggttaatgcggttgatgcaatttctgcattttctgccacaagagtaaaggcaccaacacgttcattatataaaccaaagtttttcgagaatgaactcgctactaacaattctttgtggtttgccgcaaaagcacgcaagccataagcatcttcatctaatccattggctaaaccttgataagcaaagtcaaagagtggcaaccagccgtttttcgccgaaagtgcggctaattcttgccattgttctggagtagggtcaataccagtcggattatggcaacaaccgtgtaaaagcaccacatcgccttcgcttgcttggcttaaatcttcaagtaaatgatcccaatcaagggctttgcgttcagcatcataataacgatattcacgaattgtcataccgacggcattgaaaatggcattgtggtttggccaagttggggtgctgatccaaacattttgtgctttagtttgacgtttaataaattctgccgcaatgcgtaatgcgcctgttccgcctaaactttgtactgttcttgcacgattagatttgatgacttcagaatctttaccgaaaagtaacgcttttgtttgttcgttataatcagcaataccatcgatagtcagataatttttcgttttttccttatcaaataagcgtttttctgcttctttcactgcacgcataatcggggttgtgccttgcgcatctttataaacgccaatacccaagttaattttattttcgcgagtttcggatttgaatgcttcgcctaagcctaagattggatcggctggtgccgctttaatatgttcaaacatagcttttccttatgtatcagttgtgtgatggataattttatacttcagccgttttattttatcaagaaagatttttataaaaattaaccgcactttaatatttttaaatatttatcaaaaagtgcggtcattttttacattattttagtttttcaatcgcccaatttaatcctgattgataatcttcgggtaattcaattcggagcttttctaattgttgaataatgaccgctttattaggatgagaaagattgatatgcccaaccttacgcccagccctcacttctttaccgtaccaatgaagttgtgcaaaaggtatattaagccattttggattatggtttgtgccgattaaatttaccattacacttggggcaaaaatttgtaagtcaggtgttggcaaatcaagtagcgtgcgtaaatgtaattcaaattgactaatagcacatcccagttgtgtccaatgtccactgttatgtacgcgaggcgcaagttcgttaattagtaatttgtcgcctacaacaaaacattccattgccatcacacccacatagcctaacttatccataattttgccgagcattgtttcagcttgtttttgttgtgcggattgttgaggaaatgcattatcaatcacactgtaacgcaaaataccattttgttgcaggttatgcgtaacgggataaaaacgcttttcgccatttttaaatcttgcgcctacaatagaaacttcataatcaaaaggaataaatttttctgcgatcacttcaccaaataagtcatcagtgatgtccgctttgttttcatcgctgataatccattgaccacgcccatcatatccgcctgttctacgtttgacgacgactttctcgccaacagtttggaaaacatcattccattgcgttttatcttttaataaacaccaaggcgaggtagaaagattgagttcatcaagcaaggatttttgagcaaaacgatcggctaataatccaaatacatgttgattaacgaagtttttatgattgccgagtaattcagtcaaaggtgttttttcccagcgttcaatttctgccgtgatgatcgcattttcaggtaagtcaaaaactggcgcattgaaggctaagggttcaacataaatatctaaaggtgcaccagcgtaacctaacattctgccgagttgtccgttgccaagtacataaaccgttgggtataaggtggagttttgcataatatttctcgttaaatttacgaaaaaaacaaccgcactttaaaagtgcggtcagatctgaagatatttttatgtgcgtggatcgggattatcaagcacattactcgtttggctttcacggaaagattgcaagcgtgaaagcaattctgcatcccaacttgctagaatttgtgcggctaacaatccagcatttgccgcacccgcagggccaatagccaatgttccgactgggattccttttggcatttgcacaattgaataaaggctatctacgccacttaacatagaactttttactggcacacccagcacaggcacaagggttttggctgcgatcatgccgggtaaatgtgccgcaccgccagccccagcaataattactttatagccatttttttgtgcattttcagcaaattcaaaaagtttatcaggcgtacgatgagcagagacgatttccacatgataaggtacttttaattcatctaaaatctgagttgcctcttgcatggtagcccaatcgcttttggaacccatcacaacagcaatttgtgcagtttttgacatgctattttctcaattttctaattaaaaaggtggcgtagaatagcatagattacatatattgagcaaacgtttgctatttatgtaagtattaatggggattattttataattatttgatttttaaattttagtaactatacttgataccaaattaatgggcgatagtttatatgggacgaactgaaaaattattagataagctcgcacaatcaaaatctacatttaattggaatgaattagtttctttgttagctcaacaaggttatgaaaagcgagaaatggcaggctctcgagtgagattttataatagaacactcgaacatacgattttgttacacaagcctcaccctgaaaattatattaaaggtggtgctttaaagtcagtgaaagaatcattaaaacaggtaggtattctatgaagttattaaattataaaggttatgttggcacgattgaggcggatttagaaaacaatatattgtttggcaaacttgcttacattcgtgatttagtgacttacgaagcagagtcattatctgagctagaaaaagaatttcgtcaatctgttgatttatatttacaagattgtttggaattaggtaaagaaccgaataagccttttaaaggtgtatttaatgtacgaattggcgaggaattgcatagagaagctacgatcatagcaggcgatcgttctcttaatgcttttgttacggaagcgattcaagaaaaaatttttcgtgaaaaaccaagtttaagataacaaaacgtatttacattttctttcatcaaaagtaggtcaaattatgttagccaaagcaaaatatagaaaagattacaaacaaccagattttacggtcacagacatttatttagattttcaacttgatcctaaacatactgtggtaaccgcaagcacaaaattccaacgcttaaatgatgaagcgacttctttacgtttagacgggcatagcttccagttttcttctattaaatttaatggcgagccattttctgcttatcaacaagatggcgagagtttaacgctcgatttgaaaggcaaaagtgcggaagaatttgaacttgaaattgtgactttccttgtgccagctgaaaatacttcattacaaggattgtatcagtctggcgagggtatttgtacgcaatgtgaggcggaaggtttccgtcaaatcacttatatgcttgaccgtccagatgtattggcgtgctatacaaccaaaattacggcggacaaaagcaaatatccattcttactttctaatggcaatcgcattgcaagtggcgaattagaagatggtcgtcattgggtggaatggaatgacccattcccaaaaccaagctatttatttgctttagtggcaggggattttgatttattacaagataaatttattactaaaagtggccgtgaagttgcgttagagctttatgtggatcgcggtaatcttaaccgtgcaacttgggcaatggaaagtttgaaaaaagcgatgaaatgggatgaagatcgctttaatttagaatacgacttagatatttatatgatcgtcgctgtcgattttttcaatatgggtgcaatggaaaacaaagggttgaatatttttaattctaaatttgtattagccaatccacaaacggcaacagatgaggattatcttgctattgaaagtgtgattgcacacgaatatttccataactggacaggcaatcgtgtgacttgccgtgattggttccaattaagtttgaaagaaggcttaacggttttccgtgatcaagaattttcttcagatacaggttcgcgtgcagtgaatcgcattaataatgtgaaatttttacgcactgtgcaatttgccgaagatgcaagcccaatgtcacacccaattcgccctgaaaaagtgattgaaatgaataatttttataccgtaaccgtatatgaaaaaggggcagaagtgattcgtatgttgcataccttattaggtgaacaaggcttccaaaaagggatgcagctttatattgctgaaaatgatggcaaagcggcaacctgtgaagattttgtttctgcgatggaacgtgcaaataacctcgatttaaaccagttccgccgttggtatagccaatcgggtacaccagaattattgattagcgatgcttatgacgaaaaaacgcatacttatcgtttaacggtttcacaatccacaccgccaaccgcagatcaaatggaaaaagtgaatttacatattccattaaaaatcgcgctttatgatgcgaatggcacgaaacaaatgttacaacataatggcgaattgttgagtgatgtattaaatgtcactgaaaaagaccaagtctttgaatttcacggcatttatggtcgcccaattccagcattattatgtgatttttctgcgccagtaaaactggattatgattataaaacggaacagttattaggcttgctgaaatttgcagacaatcaatttatccgttgggatgcagcacaaatgctatttgcgcaagaattacgtcgtaatgttgtgcgtttccaacaaggcgaggcactagaaatttcgcctgaaattttgaccgcactttcttatgttctgaataattacgagaaagatattgaactggcaacattaattctcacactgccgaaagaaatggaatttgcggaaggtttcaaaactatcgatcctgatggtatttcagtcgcaagagcatttatgcaagcgcaaattgcagaatcgttaaaagatgatttcttgcgtgtttatacccatattcgtcttgatgattatcaagttacgcaacaagacatcgccttgcgtgcaatgcgtaatctttgcttaacttatttggcttatacgaatttgggtaacaacttagtgcaaaaacactataataatgcgaataatatgacagatacattggcagcattaagtgttgcaactaaagctgcattaccttgcagagatgcgttattagctgattttgaacaaaaatggcaacaggatggattagtgatggataaatggtttgcattacaagccactcgcccagatgaaaatgtgttggaaattattcagttattaatggatcacccaagttttaattttaataatccaaaccgtttacgttcattagtgggtagttttgcaaatcacaatttaaaagcatttcacaacgtaagcggttctggctatcgtttcttaacggatgtgttaatccgtttaaatgaaagtaatccacaagtggctgcgcgtttaatcgagccattaattcgattttctcgctttgatgctcaacgccaaacgctgatgaaacgtgctttagaacgcctaagcgttgtagaaaatctttcaaaagatttatttgaaaaaattgagaaagcgttgcagtaacacttgatgatgtgagaataggttttatgactattctcactttattcaattgcttaatatttttaaatgaactaaaaattttttgactgcaaataattttctacagtatctacaatagcttgcgtttgaggatcgatttcaatattcacaatatcgcccactttacgttgccccattaacgttctttgcaaggtttcagggattaaattcacacagaattgcgtgccttttacttcaccaatagtgaggctaataccatctaccgcaacaaatcctttcgttaaaatgtatttcattacatctgcgtttgggagctcgaaccaaatttgtcggttattttcactagcgataatatctgaaatttttgcggtgcaataaatatgaccagataataaatgtccgccaatttccgttcccatttgcatagcacgttcgatattcacataatcgcccacttttattgtgccgagatttgtaatttttaaagtttcttgcatcagatcaaagctaaccagatcgccattgatttcagttacagttaaacatacaccgttatttgctattgatgcgccaatttccagatctttacgcatttcaggtagtaattttaccacttgtgttctaaaattagccgtttctttaatggagtggatgggggcggtgccttgtacaattccagtaaacataattttttccttttctaaaaatttttagcagtatatcaaatttatgaattttcgtcttttatctcaataccacgctgatattaaaaagttgattaaaatttccttgcctattttattagcacaaatcgcacaaaactcaatgggattagcggataccattatggcgggtcgtgtgagttccactgatatggcagccatttctattggtgcttcaatttggatgccattgatgctttttggacaaggtttattgttggcattgccgcctacaatttcttatttgaatggttcaggccaacgccatcgcattgcccatcaagttcgccaaggcatttggcttgtgttaggcgtgagtattcctttagggttgctgatttatttctgtgaaattccgctgcaatatatgcaaatggaaagcaaaatgtcagatttagcacgggattatttacatgcgatgttgtggggattgccagcctatttgatgctgattaattttcgctgtttaaatgatggtattgctaaaactaagcctgcgatggtcattacctttttaggtttgctaattaatattccacttaattacatttttatttatggaaaatttggcatacctgcttttggtgcggtgggctgtggtattgcaacagctattgtgaactgggcaatgtgcttaatgatgattttttattcctatacgaatgctcaagaacgttcactaaaagtatttagccaattaatcgaaatgccaaatctgaaaacacttaaaaaattactgcgtttaggattacccattgccattgcaatttgttgtgaagtggcgttatttgcacttacgtctttaatgctttctccgctgggtgcaactattgtcgcaagccatcaaatcacattgaataccagttcttttatttttatgttccctatgtcgattggtatggcagcgacgattctagttggacaagcgttgggtacaggttctccacaaaatgcgaagaaaattggctatgccgcattattattagggctaacggtgacgattattactgcattaattacgattttcttccgttatgaaattgcctctattttcgtaaccgatgaaattgtcatcgcaatggcggcaaatttattattatttgccgcactttatcaattttcagataccattcaaatggtggttggtggcattttacgtggctataaagataccaaaatgattttatacattacccttttttcttattgggtaattggtgtgccacttggttacacactcggtcgtacagattggcttattccacatattgatgcgaaaggtttctggattgcttttgtggtctcactcacttttgcggcgttcttactttctttgagaatgaaaaaaatgcaggccatgagcgataacgccattttacaacgtttagaaaaacttaaataaggaactttatgcaacttccagctttacaatcggcaaaattaattcgtcgttacaaacgctttcttgcggatattgaactaccaactggtgatgtgatgacaattcattgcgccaatacaggtgcgatgactggctgcggtgaaaaaggcgataccatttggtattcacattctgatagccaaacccgcaaatatccccattcttgggagctcacacaacttgcaaatggacaactttgttgtatcaatacgcatcgttctaatcagcttgtctttgaagcattgcaaaataaacaaatcaaagaattagcaatgtatgatgaaatttatcctgaagtgaaatacggcgaagaaaatagccgaattgatttcttactaaaaggcgagggtttgcctgattgttatgtagaagtgaaatcaatcacgcttgtaaaaggtaatttaggtatgttccccgatgcggttactacgcgtggacaaaaacacgttcgtgaattactcgcaatgaaaaaacaaggtcatagagcagtggtgctatttgctgggttacataatgggtttgatcgtttcaaaatcgcagaatatatcgatcctgaatatgatcgcttattaaaagaagcaatggaacaaggcgttgaagcctatgcttatgcgggacaatttgaaatttctaatgaaattcctaccgcactttctttgacagaatcggtgccttatataaaataatattttttttgagaattattttcatttatttattgacaatattattgataacaattatcatctaatcattccaacaacaatattagataatcactccaacattcccgcctatttccccacaaataggcgttttttttattcacaaatcgctaagaatccctataataaaaccttttaaaacataatttaggaaataataatgactaacattaataccgttctcgcggaactaaagcgtggtactgatgaaatcctttcagaagcggatttaatcgaaaaactgaaagaaaatcgcccattaaaagtaaaattaggcgcagatccaaccgcaccagatattcatttaggacatactgttgtattaaataaattacgtcaatttcaacaactcggtcatgaagtctatttcttaattggcgattttactggaatggtgggcgatccatcaggtaaaaatgcgactcgtcctccacttagccgtgaagatgtattgcgcaatgcggaaacctataaagagcaaatttataaaattctcgatccacaaaaaaccaaaatcgtcttcaactctgaatggttaagcaaacttggtacagaaggtatgattcgtcttgcaagcaactatacggttgcgcgtatgcttgaacgcgacgacttcaaaaaacgctttggcaacaaccaacccattgccatccatgaatttatttatccattactgcaaggctacgattccgttgcattagatgcagatgtagaactaggcggtacagaccaaaaattcaacttacttgttggtcgtgaattacaaaaatcagcaggcaaaaaaccacaggttgcgattacactcccattactcgttggattagacggcgagaaaaaaatgtctaaatcacttggtaactatattggcgtaacggaagcaccaagcgatatgttcggtaaagtgatgtcaatttctgatgaactcatgtgggattggtataaccttctttcatttcgtccattaagcgaaattgcacaattaaaatcggaagtagaaaagggcaaaaatccacgtgatgtaaaaatcttattagcaaaagaattaattgcacgtttccacaatgaagaggcggcaaacgctgcagaacaagaatttattaaccgtttccaaaaaggcgcaatgcctgatgaaatgcctgaatttacgttttctggcgaaattggtttagccaccttattaaaagaagcaggccttgttccttccacttctgaagcgattcgctctgctcaacaaggcggtgtaaaaatcaatggtgaaaaagtcgataacgtaaaagataatgcaccgaaaggcacaaatgtttaccaagtgggtaaacgaaaatttgcgcgtgtgactgtggaataaaatagataaaaaaataccgcactttggcaataaaagtgcggtattttttattgaaattttaatttagttaaacatcgcagaaatagattcttcgttgctaatgcggcgaatggcttctgccagcatggaagaaagcgtaagcacgcgaactttaccgatcgctttcatttcttctgatagaggaatcgtgtcagtaactacaacttcatcaatggcatcgctggctaaatttttggctgctgcaccagagaaaacggcgtgagttgcataagcaaaaacacgttttgcaccacgttcttttaatgcttctgccgctttacaaagcgtaccgccagtatcaatcatatcatcaaccaaaatacaatcacggtctgcaatatcaccgataatatgcatcacttgtgctacatttgcacgagggcgacgtttgtcaataatagccatatccgtatcgtttaataatttagcgacagcgcgagcacgcacaacgccgccaatatctggggaaacaacaattggattttcaagatcagattttttcaaaatatcgtgaattaaaactggcgaaccaaatacgttgtctacgggaacatcaaagaaaccttggatttgttctgcgtgtaggtcgcaggttaagacacggtcaataccaacaattgaaagtaaatctgccacaactttagcagtaataggcacacgagcagaacgaacacgacgatcttggcgagcatagccgaaatagggaatcacggcagtaatacgaccagcagatgcgcgacgtaacgcatctaccatcacaaccaattccatcaagttatcattggttggcgcacaagttgattggatgataaatacatccgcaccacgcacattttcattaatttgaacttgaatttctccatcgctgaaacgagcgactgttgcatcgcctagtgaaatatataaacgttcagaaatacgttttgcaagttcaggtgtagcattacccgcgaagagtttaatgtcaggcattttataaaacctcaggtttagattgtcgatgagtatgagttgatgatagctgcttcaacattgcgtgcaagggagacacattgagtcctttagcgacgaaaccaaaaaatgcttctggtttttgtctaaataccgcttgcgcttctgcttcatgatcaaattcagcaaaaacacaggctcccgttcctgttaatcttgccggcgcatattgtagcaaccagtttaacgctttttcaacgtttgaataatgatttatcacaactttttcgcaatcgtttttataaggttcactcaaaagttgttcgagggattttttcggtgtattacgtggtaaatttggatcttgaaagatgacagccgtcgatattgaatcatcgggttttaatataacaaaccatttctcggcaggttcacaataagtgattttttccccaacgccttcagcaaaagcagcctgtccgtatacaaatattggcacatccgcgcctaatgttaatcccaattttgccagttcatcaatggataaattggcttgccataaataatttaaagagactaatgcggttgctgcattggatgaaccgccaccaacaccgcctcccattggaagaattttatctaaatgaatatttgcacccaattgaatattggctttttcttgtaaaagttttgcagctcgataaattagattattttccgtttttagatttggaatttctggcgttaaaacaatttgattatcttgttcccgaatactaatgtctaaccaatcgccaaaatctaaaaattggaaaagcgtttgtaattcatgatagccgttcggcaattttccattgatataaagaaataaattcagtttggcagggctagggaagcgtaatggctgcccatttgattgtgttgtattttggcaaagtgcggtagaaaattgatgtgatttcattaatgtattcattagtaaatccactcgtctacgcgaatttttaaggtttgttttgtgctgtcatttttcagcaaaatattttcaggcatcgaattatttgagtgataggttagataatctgccgtccattgagaaccatccacatgataagtaaatgcaccaagtaaatggttggtacccacttgataatccgcgttcattgctggttggcctttcaaccaataagctaaatgttctaatggcacatccatgccaatgatctcttgtaatagtagtttagcattggctgcagattgttgattgtcattgttatcggaaattgtcatcccactttgatgcatttgaatcaacagggtagatttactgattaaagaatagagtttaagtgtataagattttggattttggtattgccattcaaagcggctagaaaaacgttctgtaggactgatataaccaatttgtcctttggcttgataggattgaattttttgaatcttttgtaaatgttgttgccatatcgcatccgttttatcaatgtattgtacattagtaggacgttccatatctaatgtgcaagcggttagaatcgcagtggcaaaaagtgcggtgagaaatttaaacgttttcatattattcatcaagttaataagctcgcatattttaaggatttagtttaattgagtaaagttacttttatttgttaatttgttgggtaattcgtttttgtttgtttaaccgctaagattcttcgtttcgtcaattcatttttgattgcttgtttctcaaatccatcagcaataacttgctgtacatctacttcatttgcagagtgtaataattgattgatgtaatctatttgtggatagtctttagtttcaaaacctgttctacctcgagtatcagctaaacatacttgtagaaattcttgaaagcgttgtggttttctccacacatcaaaacgattaaacagcgttatgacggtttcagctcgaagctcaaaggctttgtgaatatgcgtgtgaaattcacaagtcagttctgcaagttcttgaaaataacttggaaccttcaagcgtttgcacaatgatctagtcggttttatgccagcttgttcatgcccataatgatgaggaagaatattttgaggtgtaagagccttgccaagatcatgacaaatagccgcaaaacgaaccgcacttttatttaggatagggttattttcagtcaaattaaccgcttgttttaataccaacatggtatgaataaaactatccacttcgggatgatgttttactggatttggcaccccatgaagggcatcgatttcagaaaataaaacgcttaatgcgcctgttttatgtaaggtttcaaaataaatttcaggatttttttcgtttaaggctttttctgtttctagccaaacgcgttccgccgtgagatgttgtaattctcccgatagggcaagttctgtcattagagctaatgtttccgaggcgattttaaaaccgagagaatgataacgggctgcaaagcgtgccacgcgtaatactcgtaaaggatcttctgaaaaagcgggagaaatatggcgtaaaattcgattttctaaatcttgttttccgccataaggatcgataatttcaccgtcttcgctttgagccatcgcgttaatagtgagatctcgtcgaattaaatcttgttctaatgtgattgttggggagaaatcacaaataaagccagtgtaacctgcgctagatttacgttctgttcgggcaagcgcatattcttcttttgttttaggattgagaaaaaccggaaaatctttgcctacttgctgataaccgagagagagtagcgtagcgtggtctgcgcctaccacaatccaatcacgatcttttactggtaaccccaataattgatcgcgaacagccccaccaaccaaataaattttcattcgtgattatgcccaaccatcacgacggcgacgttttggtaatacataaggaataagcaagccgaagagtaagcctacgcccaatactgaaccgccataaataaaccattggatcgcaatttctcgtttacctgcatcaagtatcgcttctaaatcacgatttttatttttggtcatttcaagttcacgtttaagttgagaattttgctctaaaagatccgcactttgttgctcagcttgtttggttcgacgttgcatttcgacggtacgttgttgccaatcgccatctaaacgactaagttttaaggttaattcttggacttgcgcttttaattttggattttcttctttactacttggcgtgctacttaagtctgaatttaaaatccaagcttcacgatttttattgtcgcgaatgagtgtgtatttgccttggcgttctaatacattcaccgcttcgcctgcttgaattgaacctgcaattttaaattgttcgccagcaccacgacgtaagaaagtacttaaattttcagtaacatattgggtttccgcataagcaacatttattgatgtacttaaaagtaaagatgagattaaggctttatagatctttttcattttttccccttaaacatcacaacaaaagtgcggttaaaattaaccgcactttttattgagatcaattaattaaagatagttcttagcacatagaaaataataatggcgaaaaatgcgcctgctggtaatgtgacaatccaagaactaatgatgtttcggataaccgttaaattcagtgcagcgataccacgtgcaaaaccgatacctaaaatagctccaacaagtgtttgtgttgttgagatgggtaagcctgtgcctgatgcaactacaacagtcattgcagtagcaaattgagcagcaaagccacggcttggcgttaaatcggtgatcccagatccaacagtcgccatcactttttgtcccatagtaattaagcccacagcaatacctaatgcacctaagggtaaaatccaccaagttaaggctccacctgaaacaattttaccgccttcatttacaatagagaccactgcagaaagagggccaattgcattggctacgtcattagaaccgtgcgcaaatgccatcgcacaagcggttaataacattaaaatactgaagactttttctacggcaccaaaagtgcctttgtttgctgattgagtgaagattttgcttttaaaatagaaatggaagaaaaacattccgataagactgatggcaagtgaaatgattaaagtttcactgtttgaaagatttaagcctacgtgttttaagccttttttcatcgtcacgatacaaagtacaaacacggttatccccatataataagggccatatttttgtgcattttttaatggctgttcagtatcaaaaataagtttttgcgtacttgcaaagattgcataagccaaaatacccgagatgacaggcgtgataaaccagctaccaacgatgctgccaatatttgaccaatctacagaactagggccaatcgtaatacaggcaaatccaataattgcaccaataatagtgtgtataccagaaactggccaacccattttggttacaataaataaccaagcacctgatgcaaataaggttgaaagcatacctaaggctaaaatatcgggtgtatcaacaaattgtattgggtcgattacgccactttttatggtttgtgttacttcgccaccagctaaatatgcacctgcagattcaaaaattaacgcaataataattgcttgtttggctgttacagtaccagatcctacggatgtacccattgagtttgagacatcatttgctccaattccgaacgccataaaaaagccaaaggctgctgtgatccacaccaaccaagaaccatattgactaataatttccatagttaatttcctatgttttgttgattatgaacgcgccagcattaattcaatgcgcgaaccgactcgttgtgcttggtcagccaaaacgccaacccattcaataattttatataagaacattacatcaattggattataacggctttcgatggtgtaaagcattttacgcaatttgatctgcatttggtctgtatcatcttcaattgaatcaagttcttgaatcatatcattgactaatttgagttcacgacctttaaaacccgtttctaatagcttatccatttcttcgattactcggtgggcttgatgaattgcatctaaactacgttttacgtaatgtaagaattcttcctgcatttcttcaggaataccaaattgacgaccaatcatacggcctgcaatatctttggcataattggcaagtttatcttgttgcgtgactaattctaaaagatcagtacgatcgataggtaagaataaaccacgtggcaatttcaaccgaatttcgcgttttaaactatctgcctcacgttcgcattgagaaatttctaagcgtttttcttccgcttgttcccaattctttgagaaagtcgtttgaaaaaaaggaatcaaaagatcgctacattcggtcactttttcagagtgtttttgtaacggcttgagaggcgaatgggcaaataatccgagaatattattcattgccataagtgatttactccaaactaaggggttaaaaattcgtgcgcatattacctgatttttgttgatagttaaaatttttcaaaaaaatttgtaagaaaaaaggtttatcttcgactaactaagtaactgggtaatatttcctagtgtagtaagataagtaactcaatacacttttcgctttaaaagcgagaaaatttgaaaggtaaaaaaatgaaggattgtaagatgcaaagtatcggcagtggcgtaagtttattgattttacgcttttttcttgcgtgggagttttttgaagcaggattagaaaaatggaatggacaaaattggttcgctgaaatacaagatcgttttccttttccatttaatcttattccagctgatattaattggcacgttgcaatgggatcagaattaattttcccatttttgctgatatttggagtgctaacacgttttagtgcattaagtttaacgattttaatctctgtcgcgtggtatagcattcacgccgattcaggttataacgtatgtgataatggttataaattaccattaatttatgtggtgactttattaatcttaattacacagggagcggggaaactctctttagacacgcttattaagaaggtttatccaactaaaagctggttgaaatttctctaattatttattcaaaattcaaactctaggagattattcaaatgaaaaaattagcaacattaacagcattagcaagtgcattaacgatggcagtagcgacagcagtacaggctgaatcaaagtcaagcaatactgataatacagcaacaccttgtgtaggcgataaatgtgtcaaaacgaaagccgcagaaggtaagtgtggtgaaggcaaatgcggtgcagataaagctaaatctgctgaaggtaaatgtggcgagggtaaatgtggtgcgagcaaaccgaaagctgctgaaggcaaatgtggcgaaggtaaatgcggttctaaataagaataataattatgctggcgtaacaatttatgccagcttttattaaaaaggagttaattatgaaattacaaggcgctggactaggttatcgtcggaatttagctgaggattttttacaacttccctcaaataacgctattcaatttattgaagtcgcaccagaaaattggagtaaaatgggtggaatggcacgttatcaatttgatcaagcagcagaaagatttccgttagcagtacacggtctttcactttctttaggtgggcaagcaccacttgatcgcgaattactccgtaatacgaaagcattaattaatcaatataattcgtctttcttttctgaacatttaagttattgtgaatgtgaagggcatttatatgatttattacctatgccatttacagaagaagcagtaaaacacgttgcacaacgaatacgtgatgtgcaagatttcttaggattacaaatttcattagaaaatacttcttattatttgcattctcctactagcacaatgaatgaagtggaatttttaaatgctatcgcacaagaggctgattgtggcattcatttagatgtgaataatatttatgttaatggtgttaatcacggattgcttgatccttatatctttttagatcaagttgatgttaaacgtgttaattacattcatattgcagggcacgatgaagaacattctgctgcacaagttgtagagaattcagcaaatgaatcatttaataaagtaaaaggagcatatcgccatttacctgaattattaattgatacacacggagaagctgtaaaaggcactgtatgggatttactcgaatatgcctatcaacgactacctacgattcctccaacattattggagcgtgatttcaacttcccaccatttgcagaactttacgccgaagttgagcatattgcacaattacagcaaaaatacgctcacacagaggtaatgtcttatgcagcctaagtcatcattgaaagaaactcagcaagcattggcaaatgctattcggttaggtaatgcagatcctttaaatggttatgctgaaagccgtttagcggtatatacacgtttagttcgtaataatgcttttggttttattgatcgttgttttgttgaagcaccattgcatattgagctagagtattggaaaaatgctaaagaaaattttgtgcaaaatggtaatgcccattctccttatttccaagatattgcaggagaatttctcttgttttgtcaagaaaaagagatatttgatacaaatatattggcattgatggattttgaaaatacacaattactcgcagaagtttctttagccaaagtgcctgaaaaatttgagtggaatagacatagcgtaatgcaattatctggtgcagcttatttaaaaagttatgaagttgattttttatcaagtgactttaaacaatttgatgatacgccaattcaagttattatatggcgtgatagtgattttaggattcagcaacaaatcctttcagagttagattactggttgttaagttatctacaagaacaaccaaattcattagaaaatgttttgtctgctcttaatacaatggttgaagatagtacgtcaataatcccattattagagcaagtatggatgaaatgggttacatctgaagtaatttaccccgaacaaagataaaatttttgaaaatgctgagtaagatgaaaatattcatattttcatcttacttattttaattgacatttcacaattattgctaatttagattagtaaatattcacattttaatctggctttgttatttaaaattatcaatattatccgatgaaatctgtttatgtttttcggattatttttttatttaaaagtcgcaatattttaatcacaataaataaaaatttgtttgtagataaagccatccaacataactctcacgcataatccaacatcaatgagaagaatttgggggaagtggggaagaaatgagaaaggagaaatgaagcggagttacacatagataaaaagaaaacctagagacttttttacagttactaggtttatttttaggattgggcgaatatattaaacggccgtttggcaatttcttctttctgcacacgtttgacgattttgtagatccattgcaacgataaagcatacttcttagcaagggagacgtgattattacttgtaaattcgttgaaaatctgcttttcacgtttgcaggcgaaaagcgatattgatttcggcatatacacattcaaggcatcctagttgtagcatgacttacgtgatatcaagcaagccaaaggtattaacttgtccgttgatttttgggaacaattgtcagagaagttcagaaattcgaccgctatatggtttgttaatgctgcttgctttaaccattgtaagtacgatgcaagtggtaggcgttattttggtggtggtaatgttaattgcgtcaagaattaccgcacttacgctcacaaatcttttgataaaatgttatggattgctattataagttcaattatatcaagcctaattggtgtaatattgagctatcattttgatgcctcaacaggtgcttgtattattcttctgcaagccacattttttgttatagcattagcttatagcaagattagaacaagataatttttctaccccctctttctcaaagaggagcacaacctgataacatcatttacattctaacccgaggacatcgtttacatttttcccgtaaactcatcatcaaaatacctaatccactggagattgatgatgccttggatagagaccgatgcgatgcaacagcgtgtacttttcttaaaagcgtggctaagccaacgctatactaaaactgaactgtgtcagcagtttaatattagccgtccaacggcagataaatggattaaacgccaccaacagcttggctttgagggctaaacctcatcatagccctaatgccacgccataatggatttatgactggcttatcagtgagaaacttaaacgtcctcactgggggtgccaaaaagcttttagatagctttactcagcaatcagaagttttgctattcgctaactattacggataatttcagtcgctttttattttgctgtaaggggttgccgaatacaaaatcagtgcctgttattgctgagtttgaacgtctttttgagtaatttggtctgccgtattcgattcgtaccgataacggctcaccttttgcatcgcaagcattagtgaatcagtgaactttctaaatggtggattggcttaggtattcgtcctgaacgaattcagctatcacacccagagcaaaacggacgacacgagcgaatgcactgtagcttaaaagcggcgcttcaacctcaaaatagctttgaagctcaacagatattattcaaccaattcttacgagaatacaatgaagaacgttcacacgaaggcgtttgacatatttattatcgcttttatttactgggcagttttgatgccaaggaaattaaatttgccacactgtggcataaataagctaatgaatgtaaacgatgccttagggaagatgcaaactatgtttgggttgtgtattccatgccgtggttagtaatgttttgtcaaccaacttcgacagtggcaatcttgctgaatcgttttcttctcacgcgctacgggtgtgttccgctctaatttgaccgcttatttgtaccgccaaaatttcttggctactcctcgatgcatttatcgcaccgactatatcatattctttgcgatatatctgcgacttgggtcatttttcgataggatggtaaatggatgtttatcatactacgtaatttgtaatccaatcgccgtctgaactcataccaagattggtctaatatcgctcggttcaaacttgatttctatttcacgtttttgccgtgtttttccgctgtgcctttggctgatttagacatattctctacctgtaaatcttcaacataaatcatcgcgtgtttttttgctgattcggtgtggggtttgatgcaagtcgtttttttgtgggtattggtgattttgtggtgcaatttggtgattttagcctttaatttctgccagttttggctaaaatctctgccataaaaggcagagttttacggcgggaggctgataaactgtgagcgcgcgggagcgttataaatataaaagtgcggttgatttttgagagttttttaaaacgctttgaaaattggccgcacttttactttaagaaaccgttattttttactcaagtgctttcgtttccattcatttgttttcttaagcagtattttacccaatggacgagggtcgcctgtaaaaagcttttgtaagccgttgttttctatgatgtaacgacggagttcaaggcgttcttggtggttttcagccaaacgtaaagcacattcaatgtatgtttcgcgagtatcggctatcagccattctggtagtcctaagcgtttaaacagaccttcatcaatatgttcatgtacttcatcccccgttttgcatacaccaactaaacctaatgtaaccatatcaattatgccgtttgtattaccgaaaggaaacggatttagtagcatatcgcaatcacgcaatattgccagataatcgtgataaggtgcgtggggatgtgcagtggcatcgtcacctaaatagctttcaataaaccatttgacataagggtgtgtcaagcctgttgattgtccaagtgcgaaatgaaaatgtattttgactttagctttatctctgatttcttgcaatgttaccaaaaattcagggtttaatttcattgtggtagcggcaataccgatattgactacttcagggttttctcttagtacataatccactttttgtggggcgagtgcagatggtacataaggtagggcatctttgggtaagcgtaaaagggtttcgctgaaacaatcttcactgcccacataatcatcttctacgatgacataatcaataaattcagagtgcgtagtggcaggatgacccaaggctacagcttgaataggggcaagccgagtgttgctcacaaaaatcgtggtaatatccatgccaatgcttggcatatagaaaactgcgggctggaaagtttcgcactgtttacggataaaaaacagtctctccattatattattgctactgatttcaaaaaactcgtcaaacacttctcgacctatttcatcgacactctcagagcctaagccaactaaatagaatttttctcgagccgcaatcattgaagttgagtgtgtgcgataaatcgaatgccccgaattaaaatgttcaagcagtaccatcattacaggtttgccgtcctttttacctaaggtataaaggtagcggtcttgccatccttgcgtgaggatatgtttacggacaagttcgtttaatggacgcttaacatcgtgcttgttttttgctaaatcataactgcagtgcatatatacatcatgaaggatgtttgcaggcaattcatttaaatcagcaatttcggcgagttttttaggaaaccactgtaaaaccaccgctcttttatgaaacgcagatgcggtaccaataaaacgtgaagattgcaacgcaaaacacaatgaagcacaaagttgttgattccctgcccataacgcatctaaactcatattgatattggattcgggcaagtaaaaaatacagaatttagcaatagaagagttgtctgttgctaaatgaaagccaccttcggaatctgggttgatattatatttattgagaatgtggtctgcgttaacgtagggggaggaagcaaaaatcagcgtcaaccagcgttgcagactaatcatctttaatgccccttcttcggaaattgccaattcggggtcggaaaagagtgttgtaattgcattagcgagacgagtggcaaaatgaattagtagtttttcgggtagatatgccagctgagcgggtgcgtcaaattcaatatcgtgaacgcctccaaaattagcatccattttttccagaatcaccattaattcacgacaagcaaactcataatcttttttttcgatatgttgttccaagcgcaataggctaggtttgggtgattgttgaagcatttgcggggaagtttggttgttgtttgattccacaagtgaaacggtcgtattttgtggagcgttttgcaaattttcttttgtcatattattaaatcccttgtatcgccatggtgtggagtatattttagtttatcatataaattgttttttagcattgcttagtttactttacttggttttcttagttttcttagttttcttagttttcttagttttcttagttttcttagttttcttagttttcttagttttcttagttttcttagttttcttagttttcttagttttcttagttttcttagttttcttagttttcttagttttcttagttttcttagttttcttagtttgcttggtttatttatttgatatacaggggtgaaaacagggttgcgtatagactgtaaattggcgggtaaagcatatagttataaactggtaggcggaacgcttaccagttgattaaatttcagggttagaaactgaatgttaatctaccccagaaggttgtaggtgagcttgtgcgttttttgttgccattcaaattgtcactattggcatttgcaaagcgacgagcaacaaaagcatctaggcttaagttttgtgtaggagaggttttaatgcctaaccccgcagaggatactgtgtgcatatcttcaccgtaaattttagcattttcgctattataacggaactgacctgcatcataaaacgcataagggctgatttgaaagcgggtgtattttggcatacttaattcattacgccatacaagaccgcgctcaccacttgcaccgccgtatttaaagcctctgacgccataagtacctgttacagagaataaatctatgctacttatatcttgtagagtagactgacccgataattgactgctaaaatgccaaccttgagcaaactcttgactcaaccctaaactggctgtgctaatgtgatagctgcgattaaatgtttcgccaatgcgctccattccaaaagagcctggtaatttactcgcgtaataatgatgagttaaatcaatattaaagattgttttaggggtaaattggatatgtccatcaatgcctgcacttacgcctgatactgcaaattttttcttcgttgcacccagggtgtttaactcggatgtttgattaatatggcggtagttgtagcctaaattaattttaaactggtcttccataccaaggttaaatgtcgggagataataactccatttcagattcgcagagatagattgaccttttgataatttacgattaatcgcacttggtaagccgtcgatatcattagaatcagcataactcatgctggtataaaggcttaaggattggtgtttactataaaacggataagtatatcccacgcctaccgcataagattttgaaggtgctttcacattggttaatgcgtttaggtttaacacatcatcatgtccagttaaattggcattaacaaaacctaaacttacacgttgatagttaaactcccttgcaccgaaattatcataagaaataaagctacgcgttttaccaaaaggcgagaagcccgcaattatcaaattggaggttttgtttttagggtttagttcgtaatgtacacgggtaaccttaagcgggttctctttcgccatattaaattcacgcaaatcgaaccactgacgaccatcttcatacacttttccttgtttcaaagatggcaggctacgagcgatattttcttcactataaccctggctcgccttataaaaaacttggctttctgcggctgatttcgagactagctcaaacatgatattgccatccgtaatggtttgttgtggcaatatcacatcaaatttatttggctcaattttatctagcacagcctgtaattcaagctgtgctgtttttaggtttgttaaagtttgcgtaccttggtatttggataaagattttgctacagataattgggcgtcttcacttaaagtttcaagtgcgccagatagctgaaaaccttttactaaaaacgcttcttctgcatacaacgatgaagaagccaagccaagcaatactgatattgcactgagttttaatctgctttttatatttttcataataataacctgttaaaaatactttattgtatttttcgtaattttttacaaggtgggtgaaagcccgtactgaactttaacccacacagtaaataatacgaaaataaaatgacttcattgcaggatgaaatctacctcgtcaattactgactactgctgtccatcgtcagcaacattggtacatactgctgcgccatcaccacttgagaaacacgccttaccttcagaaattgtcacttgacttgatggtctggttgtaaactcgttctgcgtattaaccgtaatggcattatttggctcaacaaaacgtacggcacttacaccaagtttggctagcgtttctctttcttcatcagataaatcttttaccttctcaagggcacgcttcgcttcaattacttcttctgcgcttgctacacctggctgaatgtatttcacatcaatttcagcaccttttaacactacagtgtttttaccatttttcgaaatgatgtttaatccgtttattgtgcttaaatctccagtgatgtttacgctgcttgaggttaccgcagttacgctaccagagccgcttgcgttgactgcattcacttctgtacggtcgcctgatgcatcaccatttagtgtggcgtcttgtgcgttaataactaaggtgccttcgtttgcgttaatgcttgaacccactacggtagttaaagtgcctgtggtatttaatgtcacattagcggcatcaatacttcctgcgatactgccatccttggctgtaagagttgtctggccattgtttgaggtaatagtagagcctgcttgagtggttaatttgcctgattctgcagttaaggttgcagctccatttgtcgcatcaacttttgcaccgcctttaatagttaaactaccagtatttgctgtaacatttactgtattgccagagattgtgccgccaattatacctgttgcacttgttacattagcctcgcctgtttttgcttcaatttttgaatttgctttggtaattaaatcattggttgctttaacgcttaccgtgttaccagaaattgcaccgccaatatcgcctgattggcttgaggtggttacactctcagttccgctaatcgtagagctttcttgggtggttaatttgcccttatctgcagtgatggtaacagcattgcctgaaacattacttacattaagcgtgtcgccgtttgctgtaatatttacattaccggaagtggatttgacttcacctttaatatcacctgttttggctgtcacttctacgttaccagtggttgcattaatggttgcatccgctttggtggtaagtttttctgacgcggtgatatttactgttttgttagaagtaatgttgttttttacttctacatttttcgcggcaatagttaagccggcattattgccactgccgtctccagtgttgtcagtattaccagatgtttccactttgctatttagtgtcacattgtgatcgttagcagagatttttgaatctttaacctggttaaaggttacttttttggcattagtaccatcagcactattggtgttaccaatagttaaatcactaccatctttagctgtaatttctgctttattaaagcctgaaatgtttaggtcttctaccaattttaactctttggttttaatggttagattggcatcacttgctgtgcttgaactagaatccttctcatcaacgcctgctttaattgttatctgcttggtgatatttactttgtcagaagaaattgtgagattgccttctttttgtgagatattgccgccaatttggatttcagtatcattaccattattcgtaatatttaagttgccttttttgttggttatatttccgttaataatggttttttgatttttttgggcattagtggtaatgtttaaaccacctttattggtaatatcaccttggatgtttaccacccctcgttttatattaatgtcggcggtaccgttgttggtaaaggtgccggtaatgtttaggctgtcattggtttctcctttaaaagtggcaccgtttaaaacggcaagatcgccttttacctccacctttgagccagttaagcttaagtttccagaggtggacacattaccaagagttagagtttttttcttatgacctttgatgctattgtcggcgtaagcttgtaatgtgacatttgcttcggcagcgatggtgatatttcctgtaatgttactgcttgaattctccccgcccagagtgacattgccgccaagaatagttagattacgagttgaattaatggcgtctcctgtgtattgattttcaaataaatctttcgtttgtttaagactaaattttgaattagttgcatttatagttaagtcttttttgatttcaaaagcattactattgcgattatgggatgttatggaaaagtcaagcccgccggtaatgttaattgaatccatgtttatgctggcagctctagaggtaagattggcgtgtatgtcaaacatcacagagctatcactgctaccggtagctgtaatgttggcgttaaaagtaataggtaattctttttttgggtctgtagcggcgtttggttttaatttaaataaggcttttgcgttagctccgatgttgaagtttgttttgcctccggtgccgttaaaatgtacgcctgcaaaacgtctacgtgctgacctcaaatcttgggaatttgagccgctatcaacgaattttataaaggtaaattttgcatcgtcattcaaagtaagagaagaaacattccagtaagagtcttttgatgcatgccagtatttagcatcttttttcgtggtttggttaattgttactattccagatatgttaatttcgccatcaaatttatgagtgaaattattttgatttgcaataaactttaaaccctcgcccgtcccgttaatagatacattattgaatctaaattgtttatcatctttattgacggttatcgtcccttgtgcggtaatttgagcatctgttgcgttacgtgcgttattgccccctttctcaaaagctacagaacccccagcggtaatatttaaaaaacccgtaccaagcgtaatatttttatgaacgtcaacccatccgccggagttaatggttaaatttccgccttcagaagtaatatctccatcaatctgaacgcctccgtccccctgaccttcactatggagaattaagtgggatctacttccgatactgattgagctattaacggtaagttttctctttgccgttatgttcatcactttggcattttgcagaaaatttgaaatggtttcattggtcagtattgttttgtcggcgttttttttagggctgttttcagtaccgtcaccgattggaaattctgaactaatgtcagtgtcagcgcgagaaaggctaggagcttcaattgttacattatcagggtccagtagccactcttttgttttaacaattgcattgctgtcaatggataagtaatgccccgacgtctccacaaagccaccagttttagcgatatcgctaccttgagcattaatattgccgtcaattaacgcaatatcgccccatacaatagcgcgcccgcctttttctttacctgatacattaattgttgagcctttttctaaagaggttttctttgctaattgaatgccgtttttaccttcgccgcgctcgtcgccgccaagataggtctctcccccttctttacctgaaaggtcgataactgcacccgtttttaatgtaactttatcgcctgtaatcatcaacttaccacctttggcttgctgattttgagcggaaatcacaccgctaatttctgcttcaccctctttggcggaaagaataatgttgccgcttttatctttgcttacagaatcggcagaaagtttacctttattgcgaatagtggcggcgcggacattgatgttaccacctttggcaaaaatatcgcccagattgattgcttcattttcaggggcagcaatgctgtaagtaatggttgggtttattatgtcgctgatggttattttttgccctgcaagtaaagaaatgctaccgccatttacgctaattacaccctcattttttactttgccgccaataaggtttacgctaccgtctttaccaacggtaattaaaccgtgattcacgatttcagcgagtgctttatccttggtttgttcaagggtgaaattacgcgccttgatgttttcgttagaaatgtctagcgtagaagcagtaaagccattagtgttaataattgcttctttacctattgtgataccatttgggttgattaaaaagacctgtccgttagaatctaaaatcccttttaattgggaaatctggtcagatgtaacacggttgaatacggcggagttgttgttttcttgtaaaaactgcaccatttcattttggtcaatgttaaattgtttccaattaatgatagcattgacactattgcggatggtggttttattgccgtctacttgcatggttgctgtaccgtgtacgacgctcattccctgtaaaccgctcgctaaaacagattgcggaatggatgccatgcccaaagatagcaatatagcggaaagtggctttaacgctaagtggcgtacttttgtacgaacaggtttttcactgcctttttctgtggaatggtcacaaccccgtgtcaattcagacacagcaaccaaagcattcaggcgtttgctgaatttgagacgatatatcttgttcatattttctcctaaggttagttgaacaattaaattactttatcatttgcgttcattcatccctctctttattctcgcttccctttccctctctctcacggttcatcatgtgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagatgaaagattataccattttatatggcggatttatactatttttttaaaatatttgcatatagattgcaaagaagctgttgtaattgttgtttgtcatcacaaaaatcttgatttatttttattgtattgtatattcaaacagttaatttgagtaaggaatattatgctacaagaaattgaattaaaattggcgatttcgccacaaataggtattgaattgccacaatatcttgcaaaatttacgattttagaacatcaaaatttatttttgggtaacacctattatgattatcccgatcattttcttgctaaacaaaaaatgggattacgtattcgccaagaagagcaagaacttacattaacgcttaaaaccaacggtaaagttgttggtggattgcatagtcgtccagaatataatttactattaaccgaaaaagaaacgccaaccaatgcccaattaagagagctttatccttttgaacaattacctcgttcttcactacaacctattttctccacagattttaaccgcactttttggttagttgaatttcaacaatccaaaattgaagtggcgttcgatcaaggcaaaattattgcaggcgaatctgagcaaccgatttgtgaaattgagtttgaattgaaatctggcaacgtgcaggatctttttgattttgtagaaaccttgccttttgaaagggatatttattttaatagtggaagtaaagcgaagcgaggttatttgctgggctcaaaacaatttttaacagattggttaaataaatggcgtgatttcttaaaagaagaacgagaagaaagtgcggtagatttttgtgtaaaatttaattccgtgttgaaaatggaacagaaacttttggaagaaaccttatccttttctcccgcactttttagccaagattttatgaaaacagtagagcgagttggggtattttttaatctttatcattattatgatgaaaatggaaaaatcctagaagcggtggcaacagagaaacaaaaagaaacgctattgctagctttgttagaaagcaatcagaaaatctttgctgaaattcgtgacttgattcgttttcatagtgaaaccaaagacaatgaaaaaactattgaaaaattgaccgcacttttgaaaagtcgagtttattttaagcgaatgatcaaattaatggaattatcttatgacctagggtaggtataccttaggctagtctaagtgctactccgttgaggtggtttgatgttcttcaaagggggatagtataaccataattaactatgggtatataaagtgacctaggtgtaggtataccctaggctaatctcagtgttaccccgttggggtagtttgatgttccccagatggaactactataaacataaattaactgtgggtatacttacccacggcaaatacggagaatgaaatggctaaagccccgaaaacagcttatgtatgtaacgattgtggtgcagagttttctcgttggcaagggcaatgttcggcttgtaaagcgtggaatacaatcacggaagtgcggttaatttccacggcaaaatcaaaaaatgatcgttttagtggctatgcgggggaaactcaggcaaaaattcaaaccctttctgaaattagtttgcaagaaacaccacgtttttccagtggctttaatgaattagatcgggtattgggcggcgggatcgtaccgggcagtgcgattttaattggtgggcatcctggtgcagggaaaagtaccttgttattacaagttatgtgtggtttggcgaaaaatatgaccgcactttatgtgacgggagaggaatcgttacaacaggttgcgatgcgtgctagtcgattgggattgccaaacgatcaattaaaaatgttgtcagaaacctctgtggaacagatttgtaatttgtcggatcagttaaaaccgcaaattatcgtggtggattctatccaagtaatgcatttggcagatattcaatcatcgccaggcagtgtagctcaagtgcgtgaatgtgcttctttcctcactcgttatgcgaaaactcgccaagtggcgattattatggttggacacgttacgaaagacggaacccttgcagggcctaaagtgttagagcatgccattgactgttcattattattagaaggcgaagccgattctcgttatcgtactttgcgtagccataaaaaccgttttggtgcagtcaatgaattaggtgtatttggaatgacagagcagggtttgcgcgaagtgaaaaatccatcggcgatttttttaagtcgcggagatgaaattacgtcaggcagttctgttatggtactttgggagggtactcgtcctcttttagtggaaattcaagccttggtggatcattcaatgctggcaaatcctcgccgtgttgcggtgggattagagcaaaatcgtttgtcgttgttattggcggttttacatagacacggaggtttgcaaatggcggatcaagatgtctttgtaaatgtcgttggtggtgtaaaagttagtgaaacaagtgcggatttagccttattgcttgcgttaatttctagtttccgtaatcgccctttgccacaagatttagtgatctttggtgaggttggattagcgggagaaattcgtccagtaccaagtggacaggaacgtattagcgaggctgcaaaacacggttttaaacgcgccatagttcctttcggcaataagccgaaaagtgcggtcgaaaatatgcaggtttttactgtgaaaaaactcacagatgcgctcgctgtgttagataatttataaaaaatcattgcctactgaaaatgaaagtgaaattctgtagaatagttgttccttttttatgtgcaaagaaataaagaaaatggaaaaaaaacgaaataaagcattggatgcgatagatataaaaattctgaatgaattacaacgcaacggtaaaatttccaatatcgatttgtcgagaaaagtggggctttcgccaacgccttgtttagaacgcgttaaacgtttggaaaaacaaggtgtgattatggggtatcgcgcactgttaaatccagaattattggatgcaccattgctagtaattgttgaaattacattagtacgaggtaagcccgatgtgtttgaagaatttaatgcggcgattcaagagttagatgaaattcaagaatgccatttggtatcgggcgattttgattatttattaaaaactcgtgtggcagatatggctgaataccgaaaattgctggggacgacattattgcgtttaccaggtgtaaatgacactcgcacttatgttgtgatggaagaagtaaaacaaaccaatttccttgtattgaaataatatgattaaacaaattacagaacgatttacgccaagacagtatttagctgaatttttgctaggattgaccgcactttttggattttatttgattgttgcttggtcaagttatacgccccttgataattcttgggctacagccagcgcgtatggaaacacaattaataaagtggggacatttggagcgtggataatcgatcttttttttgttttttttggctatgtcgcccatattattcctttcaccgcttttctcgtgcctatttatttattgaaaacaaaagcagttaaacagctttcctgtactcgaattattttacgtagttttggctttaccatgctgattattgggctttgtgtagtgagtatgttgcttttatcaagtaatactttttatttgagtggcggcgtattgggcggatcgcttgttgtaaattggttttatcctgtattaggtaaatttggttcaattttaattggttttgtgcttgctttaattggttttattttttgttctggcgcatcattaattcgattaattgttgcattttatcattggctaacaatgaaaaatgagcaatcagaaaatgctgagcaagaaaaatcaacggaagaattagagcaaattgtgattgtaaaatcagatcgttcagaaacagaaaatctagatcaaaatcatctcaatgtagaacaaaatagtgagattgaaactcaaaaatcatctttagaggcagaagaaagctcagttgagcaaccttcgcatttaattaatattcatggtttaaatccagaggtttctataaaatcagaatatgaactcgctaacgaagatagtgaaaaaccgcaattttcttttgggtttgattctgaaagcttgcctagtgtgaatttatcgagtgattcagatgaacaaagagtgagtaaaaatgattttgtagtagtttggaataagcctgtaaaaacagttgttcaagaagatctagcaattaatcaaagtgcggatgattttacgcaagtttctttgctgacaaatgatgaaatgccaacagtttcattaaaatcaacctctgatactgaaatggcagataatcattttgctgctcaagttgatgaaaaggtagatttagaaaaagatgaagtgaaatttagcgtatctttacagaataatgtgggcgtaattgaattagacaaaaatcaagagcctaattataaaggttacagtggtagtttgattcatcctgcatttcaacagcaaacaacaaaacgtgaaaaaccgagtacaccattacctagtttggatttgcttttaaaatatccgccaaatgaacaacgtattacaccagatgaaataatggaaacctcacagcgtattgaacaacaattacgcaattttaatgtgaaagccagcgtaaaagatgtgcttgttggccctgttgttacgcgttatgaattagaattacagcccggtgtgaaagcatcaaaagttacgagcatcgataccgatttagcaagagcattgatgtttcgttctattcgcgtggcagaggttattccaggtaaaccttatattggtattgaaaccccaaatcttcatcgtcaaatggtgccattacgtgatgtattagatagcaatgaattccgtgatagcaaggcaactttacctattgctttaggtaaagatattagtggtaaaccagttattgttgatttagcaaaaatgccacatttattggtagcaggttctacgggatcaggtaagtctgttggtgtgaatacgatgattctcagtttactttatcgtgttcaaccagaagatgtgaaatttattatgattgatcctaaagtcgtcgaactttctgtttataatgatattccacatttactgacaccagttgtaacggatatgaaaaaagccgctaatgcgttgcgttggtgcgtagatgaaatggaacgtcgttatcagttgctttcagctttacgcgtacgaaacattgaaggctttaatgaaaaaattgatgaatacgaagcaatgggaatgcctgtgccaaatccaatttggcgaccgagcgatacgatggatgcaatgccaccagcgttgaaaaaattgagttatattgtggttattgtcgatgagtttgctgatttaatgatggtagcgggtaagcaaatcgaagaactgattgcacggttggcacaaaaagcgcgagctattggtatccatttaattttagccacacaacgcccctctgtggatgtgattactggtttaattaaagcaaatattccaagtcgcattgcctttacggtggcaagtaaaattgactcacgtactattcttgatcaagggggtgcagaagcccttttagggcgtggagatatgctttattctggacaaggttcatctgatttaatccgcgtacatggagcctatatgagtgatgatgaagtcatcaatattgccgatgattggcgagcacgcggtaaacctgattatattgatggaattttagaaagtgctgacgatgaggaaagtacagaaaaagggatatcaagcggtggagaattagatccactctttgatgaagtaatggactttgttattaatactggtacaacttcagtatcttctattcaacgtaaattcagcgtaggttttaaccgagcagcgcgtattatggatcaaatggaagagcaagggattgtcagcccaatgcaaaatggtaagcgtgaaattttatcgcatcgtccagaatactaatttaaaaggaaagtaaaatgaaaaaaacaaccttaaaatttgccgcacttaccttacttggtttgagtaatttggcattggctgatgcggcaagtgaattacaaatgcgtttagctaaagtcgatgtattaagtgcagaatttgtgcaaacagtgacttctggaagtggaaaaaatgttcaacaaggaagtggcaaacttcaaattaaacgcccaaatttattccgtatggagactaaaacccctcaagaaacccagattatttctgatggtaaaaccttatggttctacgatccatttgtgcaacaagtgaccgcacaatgggtaaaaaatgcggtaaataatactccttttgttttgcttaccagcaatgataatagccattggcatcaatatacggtaacacaacaatcggatacctttgtgttaaaaccaaccttatccacaagcaacattaagcaatttgatattcgtgttgatgctaatggaatattgcgaaatttcagtacgacagagaaagatgggcaaaccaatctttatgttttacgtaatattacgaatcaaaccttgtctgatagcttgttccaattcaagccagaaaaaggcgttgaagtggatgaccaacgtaaaaaataacaagtgattattttaaataagggcgtagaaatacgcccttcaattttgtgagaaataaaaatgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatcctgaacgaggattgggtaaagagcggttaattttagaagagaatttactgcaagtgcttgccgaatatgttaatggggatgcacgattagccttgaattgcctcgaattaatggtggatatggcagatgaaatggaaaatggaaagaaaattgaccgcactttattaaaagaagtcttaggcgaacgtcaagcgagatttgataaacaaggtgatcgtttctatgatttaatttctgcgctacataaatctgttcgaggttctgctccagacgctgcactgtattggtatgcaagaattttaacggcaggtggcgatcctttatatgtcgcgcgccgattacttgccattgcttcagaagatgtgggaaatgcagatcctcgtgctatgcaagttgcattggctgcttgggattgctttactcgagtgggggcttatgaaggagagagagccatcgcccaagccattatatatctcgcagtagcgccaaaaagtaatgcggtttatactgcatttaacacagcaaaacagcaagcgaaagatttgcccgattacgatgttccaccacatttacgcaatgcgccaactaatttaatgaaagagcttggctatggggctgaatatcgttatgctcacgatgaacctaacgcttatgcggcaggcgaaaattatttcccacctgaattaaaagatactcaatattattttccaacgaatagaggtatggaaattcagattaaggaaaaactagaacgattacgtgagcaagataaaagtacggtgaaaaaacggtataaataatatttatttaggatttttttagaatggaatgaaagtgcggttaattttaaaaacctttttgaaattgaccgcactttgggttgcctgttataaactattaattttctgattggttatgtatatttttgccatttcttctaatttgtttacatcatctttatcattaaaaattgttttttcatttacaatttttgtcaaaattaatttcatttcattgtggtttgaaggtttacaataagataacactaaatttgcccattgagttatacgatcatctttaatgtagtttccccaaaggtcagttagaatattttcaggagtttctaaaataaattttttaattgcaagaatattgttctctactctctttaatacagcagaacaaagatgtgtttcaccacaagtatcagttattttttgttgccctcctgcagaaaactcatctcttaaactagtgtttattactccatgtttagtcactagccatagtgcgaatttatcatatttatttctaggatttcctaagatcgtttcagggaagaaagcatatgcttgagcaattaacatatctcgctcatatttttctattaccttccagtgtctaactttgggaggggcaatatcatctaaaacattgtttgaagtccaccataaactttcaccttctattaatagagatttatagtatttagctacaggagttattggattatctaattctcggagagaatcatatgtggtctccattttttcaaatatgctctcccccttttctaataacatatctattttatatctagggtaatgggttacagctatatcacataaacacgactcatatggtttggataggaatttaatatttccacctaatttaccaaatgttaagaaaattttttctatatttggaattcgtgtagactcaagaatagaactgccaattgaagtccatttatctccttgtgtactttttacttcaataccataatattgactagctacaatgtctggaaaatgtttccctgatactaaactaatagtgtcttcgaaaggagtattttgagcacaataacaaatagcctcatatacatctttttctaaatcaataccactacgtttcttatagtatgcaattctattttctgcatcatgattaagaaaattatcgactctattcattaatgccgtgaattcatgtaaaggtggatacttatttttagagaaaatcataaataaatcctatttaaaataaagattccattttttttctatatttttagcaatattataagctaatacacatggtaccgcattgccaataattttataggcattactagctgaaacagaaacgttttctgctgttttaggtaaaataaattggtatctatcaggaaacgtttgtaatctagcacattctcttatagtaagacgacgttcgagcatgcctttagataattcgttaatatatttccctccatgctctatgcttagtctacgatattcaatattaccatgatgttcagatcggattgttgggccaacagaattaagtttaatttcaacctgcccttgacaatggtttcccatatatttggcttttgaatatttttgttgagaggggtctttgctaaaattgggttcttgtagatttataaatgcatcggtgcatgtaacaacagctttcaaattttcttttccatgagttgggggaggatatggattgtaatcctcagcaatattttctttttgtaattcttctaaagcttttttatttagcgcattttttttaaaaccaaaaaaaatgacacgctcacgtgattgaggaactccataaaactgagcatttaatacttgagctggtacaactaagtatccttcgtcactagcttgaccaaaatcatgttcaataatttcttttacatctttaaggttcgttaatccttttacattttcagctatgaataatttgggttgagttatagatattacttctctcatccacatgtataattgtcctctattttcaattgagggttcatctatatttgatatttttccatgatgatttttgtgagaatcaaatcctaatcgttttccagctacagaaaaatcttgacaaggaaatccacctgttaatatatcaatgtcttttgggaaaatattgtgagtttcccgttctttttttacaagatcaacaatgctttctaagtggtagatttcgtttgcattcgctttttggtctaagaaataagaaacccatgctgctttagcatcaggtttaatatcattagcaaaaattgtctcaaaagaagtgggcgaaacggtaacccattcattttctgtggagctgatccattcagggtggagctcctcattaatagatttttttagacaagagaaactaccttcaaatccgatatccattcccccacaacctgagaatagagatattagtttcatttatcccccgaaattacatatggaaatgcgtttagatattgataaaagtgcatttatatcctaattagagttaatgttagaacaatagttataaagattttttccaatcatatatattcttctaacagtttaaggtcataataatctagtttggaattataagttaaaagtatgatattgtaaaaatactctattgatatacaaagtgcggttaattttgaaaacttttttgaaattgaccgcacttttttaatttaatctcttaagcaaattttctcaaattcactaaagaatgtaggaaaggttttggcagtacatttgggatctaaaatcgtcacaggtgtgtttgatagtgcgattagagaaaaacacattgctatacggtgatcgttataggtctcaatattggcgtgtttaaattgattgagtggaagcggttgaatatgaataaaatcttcaccttcttcgacttctgcaccgactttacggagttcagttgccatagccgttaaacgatctgtttctttcacacgccagttataaatattgcgaatgacggtttcgccgttggaaaaaagtgcggtggtcgcaatcgtcattgcggcatctggaatgtggttcatatccatatcaataccatttaattcagcgtgttcggcttggataaaatcctctccccaagtgatttttgcccccattttctctaatacatcagcaaataaacgatcgccttgaattgagtttttgccaatgcctgttactttcacttttcctttaatggcgccagctgcaagaaagtaagaggctgatgatgcatcgccttctaccaagtatttattaggcgaaatataggattgatttcccttaacttgaaatttttggtagtgatgattttcaaccttaacaccaaaatctcgcatcattgcaagggtaatgtcaatatagggtttagagactagttcaccgataatttctatttctgtgtcattttctgcaagtggcgcagacattaaaagtgcggtcaaaaattgagatgaaattgaaccatcaattttgacttttccaccttttatccctttgttgcgaattgcgagcggaggataaccctcattctctaagtagcgaatatctgcacccgcttggcgtaaagcatcgactaaatggagaattggccgctctttcatacgaggttcacccgttaagatgatttcgctttcggtttttccttttaagcaaagtgctgcggttaatggacgcattgcagtcccagcattgccaagaaagagtgaaagattgtcctgtatattgaatgttccacctaatccttctacttcacaaatagttttatcatcagacagttgatagcgtacgcctaatgctttcagtgcgttaagcatatgtcgaatatcatcgctatctaataaattggttacttttgttgttcctttagctaaggcggctaaaagtaatgcgcgattcgataaacttttagaacctggtaaattaattgttccttcaaccgcacttattggtgcaagagtaattttttccattacaacaccaccgttttatttttataaacaaaaattctatcgtgtaaagcgagatcaagggcgcgacttaacacggttttttccacatcacggccagcacgcatcatcgcttctgcattataagtatgatccacattaatcacattttgcataatgattgggccttgatctaattcgttattaataaaatgtgccgttgcgccaataatttttacaccgcgttcataggcttgttgataaggcttggcaccaataaaagcaggcaagaatgaatgatggatattaatcactcgatttggataacgtgcgacaaattcagggtttagcacacgcatatatttagcgagaacaatataatctggcgtatattcatcaattttttctgccagtaatttgtcgtgttctacacgggttaagttttcgtggctaactaaatgaaatggaatattaaaacgttcaacaagttcacgtaaattatcgtgattgccgattacggctgcaatttctacatcaagcgcaccataataatttttcattaaaatatcgccgaggcagtgagcttctttggtgactaaaattacaattcgcttacgttgggtgccaattaatcgacaattcgtttcttcgggtaagctatattttagatcttctaataaagtagcttcgttaaaaataccttccaattctgtgcgcataaagaaatgtttggtttcaaaatctacaaattcattattatgaagaatatttagttgatgtttgtaacaaatattagttatttttgcgattaagcctttatcatcagggcaatcagtgagtaatatttttttttcgatcataatgttgtgtgctatgtttagataaaaaaatagaacccataaaataggttctagtttcaaatagaaaaattaaatttcgaaatcagataatgatttacctttgttcaacgcattttgaattgggcgtggtgtgcgaccttgacccgtccaagttttatgctcgccattttcatcaataaacgcatattttgcagggcgtggagcacgttttgctcgaattgatacagtttttgtgccaaaaatttcgtgtaattcttcaggtgtaataccttctttttccattaattctttatatttagctaaacgctcttttcgctctgtctctgctttaattaattctgcttcattagcacgtttttcttcgatagctgtttgtaatttttctagggcattttctgcttgttctaacgttaattcacgtacagctgcacgtaaactacgaagatttgttaaacctcttactaattcgttcataataaacctcaataaataacattaaatgtgggaaaatttatttaataatagagaaaataaaatttattgtaaatatctattattaaataaatggtcgaaacagatatatttttttgtgtttattttctttatatttttattaaagtttataaaatttttataaaatctgttggcattttgtttgttttacggtaatctccccaatcactacaaaagtagaggcgcaattattataagtattttttcagagtggataacgaagaagaaaaaagaaaggaatagttgccgaaatcaaataaaagtcgttttgtttggttggtggcgtgctcgaaaggggcgacactgtcatagtttttctgattaactatggagtgctacggttgttctggtcttattctgtcctatgctttccgttctctccattaattataggtattatttaatggaacttattgatttttcatcatctgtttggtcaatcgtccctgctttgttggcgataattttggcgatagcaactcgccgtgttttggtttcccttagtgcggggattattattggatcattaatgttaagcgattggcaaatcggcagcgcatttaattatttggtaaaaaatgtggtttctttggtttatgccgatggtgaaatcaattcaaatatgaacattgttttgttcttattattgcttggtgttttaaccgcacttttaaccgtatcaggtagtaatcgtgcctttgctgaatgggcgcaaagccgtattaaagatcgtcgtggtgctaaattattagcggcatcattggtttttgttacttttattgacgattatttccatagtctcgctgtaggtgcgattgctcgtcctgtgacagatcgttttaaagtttctcgtgcgaaacttgcttatattttagattcaacggcagcaccgatgtgtgtaatgatgccagtttccagttggggcgcatatattattactttaataggcggtttattagcgacttattcgatcacggagtacacaccaattggtgcattcgtagcaatgagttcaatgaacttctatgcaattttctccattattatggtgttttttgtggcatatttttcttttgatattgcttcaatggtgcgtcacgaaaaattagctttggaaaatactgaagatcagttggaagaagaaacgggtaaaaaaggtcaggtgcgtaatcttatattacctattttagttttaattatcgctacagtttcaatgatgatttacacaggcgcagaggcattggctgcggatggcaaagtgtttagtgttttaggtgcatttgaaaacaccgtagtaggaacatctttggttgtaggtggattctgttcaattattatttctactttattaattattcttgatcgtcaagtgagtgttcctgaatatgcacgttcttggattgtgggaattaaatcaatgtcaggtgcaatcgcaattttattctttgcttggacaattaataaaatagtaggcgatatgcaaacaggtaaatatctatcttctcttgtgtctggtaatattccaatgcaatttttgcctgttatactttttgttcttggtgcagcgatggcattttcaacaggtacgagctggggaacattcggtattatgttaccaattgccgcagcaatggcagcgaatgccgcaccagaattattgcttccttgtttatctgcagtaatggcaggggctgtatgtggcgatcattgctcgccagtatcggatacaacaattttgtcttcaacgggtgcgaaatgtaatcatattgatcacgttactactcagcttccttatgctgccacagttgcaacagcgacttctattggttacattgtggtagggtttacttattcaggtttagctggttttgcagcaacggcagtttcattgattgtcattgtatttgcagttaaaaaacgctaaaagtgtgatctcattcaaaaacttgaataaaaaataatatttttactattttataaaatgcggcattttgtcgcatttttttatttttattgatgtaaaaatttataaaaaactaaattttcatttatctttggttttttatatttttttaattgatttttttgttgttttagtggctagacaaattttttttactttgtatgatgtggaatattgacataatctgttcgtatttttaaaagtgcggtgaatttaaggagtgaaaaatgaagaagttatctggcgcagagatggtggttcaatctttacgtgatgaaggcgtagagtatgtatttggttatcccggaggcgcggtattagatatttatgatgcaattcatacgctgggtggtattgaacatattttagttcgccacgaacaagccgcggtgcatatggcggatggttacgcacgttcaacgggtaaagttggatgtgtgctagtgacttcggggcctggtgcaacaaatgctatcactggtattttaacggcttataccgattctgtgcctatggttatcatttcgggtcaggttatgagcaatttaattggcagtgatgctttccaagaatgtgatatgctgggtatttctcgtcccgttgtgaagcatagctttattgtcaaaaaggcggaagatattccatctactttgaaaaaagccttttatattgcatctacgggtcgtccaggccctgttgttgtggatattccaaaagacactgtaaatccgaattttaaatatccttatgaatatcctgaatctgtcgagttacgttcttataatcccacagtaaatggacacaaaggtcaaattaaaaaagcgttaaaagcacttttagtggcgaagaaaccaatactttttgtcggtggtggcgcaatcactgctgaatgtagtaagcagttaattcagtttgcacaacgtttaaatttaccagtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggttttggttttcctgcggcacttggtgtgaaattagctcatcctgaaggaactgttgtttgcgttactggcgatggtagtattcaaatgaatattcaagagctttctaccgcaacgcagtatggtattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggagcaatgaatgaaatgattttaagtaaacctcaagaggagacaaactaatgcgtagaattttatctgttttactcgaaaatgagtctggtgctttatcgcgtgttgttggtttattctcacaacgtgcctttaatattgaaagtttgacggttgcaccaacggatgatccaacgctttctcgaatgaccattgaagctgtgggcgatgctcaggcattggagcaaatcgaaaaacaacttcataaattagtggatgtgtttaaagtggttaatttaagtgagcaggaacatatagaacgagaaattgttttagcgaaagtaagagcagtggggtcatctcgcgatgaaattaaacgattagcagatattttccgcggtcaaattgtagatgtcacaccaaagtcttacacaattcaattaagcggtacaaatgataaagttgatgcgtttatttctgcattgaaagaagaaactacattgttagaaattgttcgttctggattgattagtgtgtctcgtggagaaaagaatattctttaaagtaggggcgtaaagtgcggaaatattttaatagaattttaccgcactttattagaaatatatttgtttttagtttttttataaaaaaattgtgaccaagttcacaaatctaaaaatatgtatttgcataactgatcggatttctttattctgaaaccactaaaaacaagtgctatcttaaatagccgacatctattttgctttccgagtagtgccccaatggggcactttttttattcagtaaacaagtataaaaaatccctttcctgagaaagggattttaattatctaaattacattttttctacggttttaataccgagtaacgttaaaccctgttttaaggttttttctgttaataatgccaatttcaaacgacttaattttatagattcattttcagcatttaaaattgggcaatgttcatagaatgacgagaagatgccagcaagttcatataaataagcacaaagcacgtgtggtgtgccttcttttccgacagtttgcacggcttcttcaaattgtagaagcttgattgcaagcgttctttctttatcatctttaatagttaaaggtgcagccaaaagtgcggttgaatttatatctgttttattaaagatcgaacgaattcgagtgtaggcatattgcatataaggtgcagtgttaccttcgaaacttaacatattatcccaatcaaaaacgtaatccgtggtgcggtttttggatagatctgcatattttaccgatccaataccaatagcctcaatcacagcttgtttttcatcattagataaattggtatttttttcattaattaatacagtggcgcgttcgatggcttcatttaatagatcggctaattttaccgtgccaccagtacgagttttaaatggcttgccatctttaccaagcatcatcccaaagtttttatgctctaacgagaaactgtctggtacataacctgctttacgagtaattaaccaagcttgttgcatatgttggctttggcgagtatctgaaaaaacaagtgcgcgattagcttttaatgtttcataacgatattttgctgcagcaatatcagttgtagtataaaggaaaccgccgtcttttttttgaacgattacacccattgggtcgccatctttatttttaaattcatctaaataaacaaccaatgcaccatcattttccacagccaaaccttgttttttaagatcttctacgatgcttggtaacataggattataaagactttcgcccattacatctttttcggttaaagtcacgtttaagcgattatagttgtgctgattttgttgcatagtgatatcgactaaacgtttccacatcgttcgacaatattcatctccactttgtaattttacgacgtaattacgtgctttttcagcgaatatttcatcttcatcgtagtgttttttggcttcgcgataaaaggcttcaagatcttgtaattccatttcactggcgtgttcgttttgcattttttcaagataagcaataagcattccgaattgcgttccccagtcgcctacgtggttagcgcggatgacattgtgacctaaaaactcaagggttctagctacagcatcgccgattatcgtagagcgtaaatgacctacgtgcatttcttttgctacgtttggagaggaataatcaatcacaactgtttgtttattggtagcttgaatacctaaatttttgtgggaaagtgcagctgaaatttcagttgttagccaagttggatttaagaaaatattgataaaacctggacctgcgatttctaatttttctgcaatatcagatagttgaagattatctaaaactttttgagcaaattctcgtggatttaaacctaatttttttgctgcagccataataccgttggcttgataatcgccaaattgtggtttgcctgattgacgaacaagcgcatcacaagattgatcagcacctgcaataaccattgcttgtttaattttatcggatagaatagattgaatattcacgttttttcctatgttcaaattgaataataaaaataatcggttatgataccgttctttgtatatttctcaaagggacaaaatgacaaatttacaggaaaatttgaccgcactttcagcagatttagcaacatttgaaagaaaaattcagcatttagccaaagaaatgacaatagatctgtctcactatgaaatcgatcatcttgcattacgggtaaatagtgagcaaactgctaaaaattggctgatacttttattaaagtgcggtagaattttatctgataatattgttaatggtcgtaagatttatcttattgaattagaaaaaccagttaaatttgccaatcaatttgtggatattattgaacttccacttcctaaaaataaaaaatatccaattgaaggttgggaacatattgagattgtagtgccatttttaccgaatgaatcgataaatgaatggattgaccgtgttaatatgtattttttatggaacaaattaactcaattaaccattaaagtgagcgagcctaaggtggatggggaaagattaccaaatccatctattgcagtaagttttacggataaaacagtaaatcatacttgcattaaggttcatccttattctattaaaaaaaactttgaggtttagtaaaaatgaataaattatcacttgctttcgttggtttagcaacagtaggcttgagtgcttgttcttcttttcaaaaagatgaaaatgcttaaaggtcaaatcgtttttagccaaatggaaggcgaaaatcttaaattaactattcgtaaaaatgattgttctggtaaccagcagaaaggagaggaagttattattgtgcataagtatgattcaactcttgctattggggcttgtgtgacggtgtctaataatagccaagtaaagaatatttcatcattttcgccaagaaatccattttaattcttaaattaaggatatagatatgaaaaagaaaacactagcattagctatcttaactatttttagtgtggctggatgtacgaatacagatatttttagtggcgatgtgtatagtgcatctcaagcaaaggaagctcgttcaattacttatggtacgattgtttctgtgcgtcctgttaagatccaagctgataatcaaggcgtaattggtacgcttggtggcggtgcgttaggtggtattgcgggtagtgcaattggcggtggtcgtggtcaagttatcgcagcagtagttggtgcgattggtggtgcagtagctggaagcaaaatcgaagagaaagtaagtcaagtaaacggtgctgaacttgtaattaaaaaagatgatggtcaagagatcgttgttgttcaaaaggctgacagcagttttgtagctggtcgccgagttcgtattgttggtggcggctcgaacttaaatgtttctgtgctataactaatagcattaaagtctaatatgattaatcagtgccttaacttagtaaggcactgattttttataattaaactcatttaaaatatatatttatcgtttatctaagataaatttaaaggactaaattagaatttagtcctagacaaacttggaatttgttcctcccctttctgaacactccatctaaaacataacatttatttttctgataaatttttttataatcttaaaattttgctttaaatcaaataatttaagatgatatttaataaaatgtaagagtgaagttatagtatatttatctaagctcatatacatatcataaagtatacttttcaacactttattacttttatccacatgatatatttctagcaacgacacactattaattacttttatatctatacctatcttattaaggtaatatgtaatattttccccctttatctttttagctacctcattttgcttatgattataaactgatgatgtttggtttccatgtagtctatattttactaatgcttcaggataattagctaaacaaccaagcctactaacctctgaccaaaacttataatcttctgcatagggataatctttattaaagattaatttatgctctctatatacatttgctctcataatcatagtgttgttatgtatcggattatagaaaagcatagcttcacaaatatcattatgtagcaatggatttttccatatatcaccagttttatatttagaaccgataatgccacattctttttctacaataatctctaagtatgatcccattgctgtaatatgatcatttttctccagataggtaactattttctcaatccacgatggtttagctatatcatcagcatccattcttgcaaaatatttacctgaaaaacaaccaaggcctatattcaaagaatttatgaaccctaaattatatttattactgataatttttatccttttatctaatttagatatttcttctaaatgagacaaagtcaaatctgttgaaccatcattgataactataatttctagatttttataactctgattaataatggatgaaatgctttcatctatatattgctcagcgttataagcacaaacaataaccgatactaatgggggattttccatataagatccaattttacactcttatttaaattgttttatacgttatttaaataactagataaccagttaaaactctcctaaattaattgttttacaatagaaatttgagttttttaaatcactgtgattaaaacgccattcatattcctttaaaaatagcttaagaatatcataacctctgtagaaattcatataaacaatactaccttgtttaccttttctcgaataatcagtaacagtgttgcagattgcatattcataaccaccacggtgtatactttgctatttcgtttcaaaaaacaaattacgaagtttttccagcttatccttgaccaagtttacctttcagagcaccaccaaaatagctttcattcgcttgaatttcaccttcaaacatttccaaatgtaggctgctttgagtgataaataatggtagacgatgaaagtaataagctgaagtttatttatatttaccaacttagctgcagctagagctgtcacacttgccagaaatatctcaataagtttattttgcttatattgacttaagcgactttctctcatttgattatcttaacctaaatagagtttttagtcgttatctgtgacagctctagaattattcaaatccaaataattaacgccatgctttaaattgattgattaatccatttgttgaactatcgtggcttgcgactttttcagaatcggttaattcaggaagaattctatttgcaagttgtttgcctagttcgacaccccattgatcgaagctaaagatattaaaaatcacaccttgtacgaagattttatgttcatacatcgcaattaatgcacccaaggtaaatggcgtgattttttgaacgagaatggaattagttggcttattacccgtaaatactttaaatggaacaatatttttcacatcatccaaagatttccccgcttttacaaattcagcctcgacttcctcttttgtttttccgaatgctaatgcttctgtttgtgcaaagaagttggaaagcaatttattgtgatgatctgccaatgggttatggctttgagcaggtgcgataaaatcacaaggaattaaagtagtgccttgatgaattaattgatagaacgcgtgttgtccatttgtacctggttctccccaaataatcgggcccgtttggtaattgttaatgacattgccatcacgatccacatatttaccatttgattccatattaccttgttggaaataagccgcaaagcgatgtaaatattgatcataaggtaagattgcttctgtttgggcaccaaggaaattggtattccataaaccaactaaggctaaagtagttggaatatttttttcaattggagtagtgcggaaatgtttatccatttcatgcgcgccatttaataacgcttcaaagttttcaaagccaattgatagtgcaattgaaagaccaatagctgaccataaagagtaacgaccgccaacccaatcccaaaattcaaacatgttattggtatcaataccaaatttttctacatctttagcattggttgataatgctgcaaaatgttttgcaaccgcactttcatctttcgctgcttttagtaaccaatcacgcgcactttgtgcatttgtcatggtttcttgagttgtaaaagttttcgatgctactaagaaaagagtcgtttctggattgactttttttaaggtttccgcaatatgtgtaccatcgacatttgaaacaaagtgcatatttagatgatttttatacgggcgaagtgcttcggttaccatataagggcctaagtcagagccaccaataccaatattcactacatccgtaatggctttgcctgtatagcctttccattcgccagaaataatacgctgacagaaatctttcattttagctaacacagcattgacttcaggcataacatctttaccatcaacaagtactggcgtattagtgcgattgcgaagtgcagtatgcagcacggcacgattttctgtacgattgattttttcgccagtaaacatcgcttcttttgcactatcaagtgcgcattcttgagcaagttggcgaagatgtgaaagggttgtttgattgatgttgtttttggaaaaatcgacaagaatttggttattgaatgttaaagaataatcgtcaaaacgatttttttcttgtttaaataaatcttggatggtggtgtttgataattcagctttatgtgcttcgagagatttccacgcttgggtgtgagttgggttaatatttttcatggtatttcctttcattaaaaataattgaaattttaaccgcactttctggaatttttattagggagaatgactccctctgttcaaaaaatgcagtgattaatcaacgtattcagttataacacgaggtgttaattttgtaattagctcgtagcttaaaatgcctgtgaatttagctacggtttcaataggtaattccttgccccataaaattacttcatcgcctaccaaatcttggctatctgcgcctaaatcaacagtgagcatatccattgacacacgtccaacaattggtacgagacggccatttaaataaacaggcgtaccttctggcacatcgcgcggataaccatcgccataacccattgcgaccacgccaattttggtatctcgtggacttgtccaaataccgccgtaacctacaggatcgccttgtttatgatggcgaacggcaattaatgacgaggttaaattcatcactggcgttaagccaaactctttgccaatagtatcagttggagaaatgccgtacataataatgcctgggcgaatacattctaagtgagattttggccagaaaagaatgccgccagaagctgcgatagtgcgttcaccttgtttatcttttgtggcggataaaaaacgattgatttgaagttgggtgtaatctgattctagttcatcggctcggctgaaatggctgacaaagcctaagtgcggttgaatttgagggagttttttcagttcttgataaaaataatccacttcatcaagagcaacgcctaaacggtgcattcccgtatctatttttaaccaaaccttaattggacttggtaaatttgaacgttttaaagcctcaagctgttcgtgattgtgtaccacggtttcaatattattaacggctagaataggcaaatcttgttcattaaaaaagccttcaagtaataaaatcggtttagtgatgccgttggagcgtaatgctaaagcctcttctaaacgagccacgccaaagcaatcgacattttgttctaaagttgatgcaacaaacacaacgccgtgaccataagcgtttgctttaaccacagcaataattttgctatttggtgctttttgtttaattatttctaaattttgttttaaggcgtgcgaactgattttcgctgtcgccggttttacgttcattatttttccttaataatcatctcgatattcacgttgttcggcaagattgtcaaagcgtgagaattgtccattaaattttaaccgcactcgaccaattgggccgttacgctgtttaccgataataatttctgcaacgcctttatcttccgagttatcgttatagacttcgtctcggtaaataaacataatcaagtctgcatcttgttcaatagagcctgattcacgtaaatctgaatttacagggcgtttgtctgcacgttgttctaaagtacgatttaactgagaaagggcaactactggcacttgtaattctttggcgagtgctttgagggaacgagaaatttctgcgatttctagtgttcggttatctgaaaatgcgggtgcgcgcattaattgcaaataatccaccataatcatacttaatccaccattttcacgataaactcggcgtgcgcgcgaacgaacatcggtaggtgttagacctgaagaatcatcgataaaaagattatttttttgcttgaacattcccactacgctagcaattttattccactcgatttcatctaaattttgacctgttcggattttagtttgatcaacgcgagcaagcgatgcgatcatacgcatcataatttgttctgctggcatttctaaactaaatactaaaacgggtttttcacttgccattgcggcattttcgcaaaggttcatggcgaaagtggttttacccattgacggacgtgccgcaacgataattaagtctgaaggttgtaaaccagccgtttttttatcaagatcggtaaagcccgtcgtaacacctgttacacctgaatgattttcaagtttgcttaaaatatcgattttttcaatggtactttctagcacattgatcacattttgtgggccttcgctagaagttgttcgtttttctgcaatcgcaaatacttcacgctcagcctcatcaagaattaacttaatgtcttgccctttaggagaatagctattttcagcaatgcgatttcctaccgaaataagttctcgtaatatggctttctcacgcacaatatctgcataagccaaaatattaatcgcgttcggagtattattagaaagctctgctagataggcaaatccacctacttcatcgctgacaccgtggcttcttaaggcttgatctagcgtaattaaatcaataggcgattgattacgcattagatgttccatttctgtaaaaattagacgatgctgaaaagtataaaaatcgtcagcaatcacacgttcagcaatgccatcccaatgttgattgctcagcatgatgccacccaacacggcttgttcagcctcaattgagtgcggaggaatgctaacttgtgctgtttttttgtctgaagatttgatttgaggttgtgatgccataggacttatttcgatactagaatgtcgcctatgataccgcaaatatctattggatttaagtgaaaagtgcggtgaaaaaaggaaataaaaaacggtggaaaaatccaccgctcttttattttaacatatttagattgttgattattcaacaattaatgtacgacatacgttagtttgtgtcgcaccttgaccaccttgggttaccagtactaaatcgccagtagataaataacctttttcttttaatgattgaagtgctgcttttgcacctgcttctgtacgactttcttcaccgtgataaattggtgttacaccgcggtatagtgcacaaaggtttagggtttcttgattacgagataaagcaaagattggtaagccagagctaatgcgtgacattaataatggagtacggcctgtgctagttaaagtgacgattgccgctacacctttcatgtggtttgctgcatacattgcagacatcgcaacagattcttcaatggtttcaaattctttatccatacggtgacgagaaacgttaatgcttggcattttttctgcacctaaacatacgctagccattgctgccactgtttcagaaggatattgacctgctgctgtttctgcagaaagcataactgcatcagttccatctaatactgcgtttgcaacgtccattacttcagcacgcgttggcattgggttactaatcattgattccatcatttgagtcgctgtaattacagcacgatttaattgacgtgaacgacgaattaattttttctgtacaccgactaattcaggatcgccgatttctacgcctaagtcaccacgagcaaccataattacatcagatgctaaaataatatcgtccatggcttcatcattagcaacggtttctgcacgttcaactttagcaacgatttttgcatttaaacctgcttgttgagcaagttcacgtgcataatttaaatctgcacttgaacgagggaaagaaacggctaagaaatcaacaccaatgcgtgcagcggtaataatgtcggctttatctttttctgttagggcatccgcagataaaccgccacctaatttattgatacctttattatttgataatggaccaccaacagtaacttcagtgaaaacttttgcaccatcagttgataatacttttaattgaacacggccatcatctaataaaagaatatcgcccggcacaacatcttgaggaagcgttttatagtctaaaccaacggattcttgagtgccttcgccttttggtaattctgcatcaagaatgaatttatcgccaacgtttaagaaaattttaccgtctttaaaagtagaaacacgaattttaggaccttgtaaatcacctaagattgccacggttttacctaattttttcgcaatagaacgtacacgttcagcacgtccgatatggtcatcaggtgtaccgtgagagaagttcatacgaactacgtttgcgcccgctgcgataattttttcaagattgttatcacggtcagttgatgggcccatagtacatacaatcttcgttcttcttagtcttctagacattatttactccgtcaataattacaaaattttaaaggtgttattttacttcgctacatatattagccagataaaaaatcggtgcacattatacgcttaaaacttttggaaatcaaaaacggctcagttatttaagctggttttgtttacttttttgccagttatatcgggttttaagaaaaatacttgtgttcaagttaaaaatatctataatcacgactacttcacacagtgcgactatagctcagttggttagagcaccaccttgacatggtgggggtcactggttcgagtccagctagtcgcaccaaattttcttttcaatccctctcaatccatatcaaataaaattaaatttcctggtaaatcaaggcattatctgcttttataaagtcaatctatatcaatctatattaatctaactcacttttttggtattatatttggtaatataattttggatttttaggtgtcgtaataccaaaattcataaaaatactaaaaaatcacgcttaccaaaattattttcgtaataccaaatggggggaaggatggctgtattagtgaaaccattaagcattacagaaatcaataatgctaaacctaaagagaaagactactcactgtctgatggccaaggtcttttcttgctcgtaaaaatgaatggttcgaaaatttggcgatttcaatattataaaccaatttctaaaaaaagaactttaattagtcttggtgtttatcctgagatttcattgaaagatgctcgagagattagggatttatatcgttctttgttggcgaaaaatatcgatccgcaagattatcgtttacagcaagaacaaaaagccatccaagaacgtcaatttaccttgagcgaaatggggaaggaatggctatacctaaagaaaaatgaagttgatactgggcgattaaaagaagtgacttttattgatattgggaaacggttagaacgtcacttgtttaaagtgttggggcattattctattagtgagatttctgctcctcttgctattgagaaattaaaaccattagaacgagcaggaaaattggatacattgcatcgtattattggttatttaaaccaaataatgatttattcggttaatagaggggtaattaattataatgcaaccgcagatattggaagggtatttattcgaccaatagctgaaaataaccctactattcgcccagagcaattacctaaattgtttgaagatttgcagaatagtacccttgaaattgaaactcgttgtgcattagagctactactacttaccgcaggtcgggctggggctattactcaattagaatgggaaaatgtagatttcgaaaacagcttattgaatataccgaaagaaaaaatgaaggggcgacaaggtaaagtacaagattttatcttgccattatccaaacaagctgtaacgattttgcgcttgttacagaagttgaatcgttgcaatagtaagtttgttttccctagcaaaaaaaatccaagacagcctatatcgaaagagacgccaaataaagcacttggacggatcggttataggaatattttgaccgcacatggtttacgatctgtttttagcacagctatgaatgaggccgaatttaacagtgagattattgaggtgtgcttggcacattttgaatattcttccgttcgtggcacatacaataaagcaaagtatatgccacaacggatcgaatatatgcagtggtgggggaattttgtagaagaggcatctgatgggaaagcattaatgggctgttaagatgaatagcagcctgattcaattctttcaatgtaatcatttatttgtgcatcagtccaaaagttattcccaccgactagatgaggctttggaaaattggggtcgttttttatccttctgtaaattgttggtgcgctcatatctaataaagcagaaacagttttcaaattatgtaattttcttgtcgtagattccatatttcctccaataaaaaccgcccttatgggcggttataacggtttattttagttagcccacttcatctaacttattcatctttttgtaaagaggatagggcgatttaatgggttgtaaatgggttttaaaaatcgttcgggtcgtcgtcttcctctagctctatcacatcaagccgttgaataacttcaaatttagctaaaaaacgcagtctgttctcaaaatcaccatctctccatacatacataacttcgcgttccggttcttcaaacatatcccaggaataagcgttttctttcgcgatatgtaaagcgacattatcaaaacacctactttcatcttcccatgtatttccatcatcattgtttgtaggattgttactttccaatgcgtaacgatataaatatttagccataatttattcctccggtggttgtggtagcggttgccaataaataacctccacttcctcgccagggttttcatccgattcccaatacggaattaaacaaccttcacaatccgacttatcgtcatataaataccagccaagaccaacagcccaatgatcaccatcctcagtaaaataaattaggtgtttgttagttgcattacgatactctaagtcggtagaaaatggttctggtagttcgtttgcacaattaatccagccattattttcactcatttttcccctccaaaattgctttgcgttttgctttaataattggcgtaactacccgtttaatcgccagttgcaattcacctataaaggtctcatctttcatattgtcaaatgcaatacccatcaacttcgtcaaacacaccaccttcccagtctaatagcacgatatttccgcctaacacttgcgtattttttgatattttaagttgatcacgttggtagtcgtccatttcaacttcgattgttatgcggactttttgggttatttcattgctcatttcctactccttttcctttgtaacttggatattcagatctcaaaatccgataacaatttgtttttaactcaaaaatgcttctcggcagagcgttaataggcaatgttttacaggctctcccggtgtcgtccataccatacggcacaccgattgcgcgccaacatcgtgcggcatgtaccgctgcgtctttaaccacatccgagttaatcacaaagctattcggcccaatgcgttgcaacaaaacaccttgtgccataagctttttaacccgccgtctaaattgactttcgcttaatccagagccttcaataaggtgtcttacactcaatattgcaaagtcttctgctcttttctctgcatgatcatcgctatacgtgccaacactgccaccgatatacgttaccaaggtgtgttgtgcgatgcggtctaatgtttcatcccagatatactcaaggatatgttcgtctagcactttcatatcttccccaatctcattctcatccctgacaaccgctccgaacatttaatccattcgctcatatcacaccaccaatacatataatagccattctgtgaatcctttcatgcttactcctaatataaatcttctgagaacagaatatctgagtttggtgaaccagataaacgaattacttggttctgagctttagcaatttccattgcttctttacgacctacaaaacgacctttattagttagaaacccttgttcccaatctaaaagagcatacttgtattgtttttctaattctttaatctgcttacgcatgaatgggtcatagtgtcttaaaccatatacttcatggataatctcaccgccatcttcatttgtaccatctctttcatctacaaacacttggcaagcagagcatacaattctttcaggaatatctacatattctcttttttggtttaagagtttaataaattcattgaataatgtttgtctttcttcaggcgtttgttgtttgattaaattaataatatccatcacttactccatcatactcttcataaaatcaagccatttttgagcatcttcttttgtgcggaaacattgaccatttatcatcaagttagctgcacaatctgcataaaacgaaaaatatctaatcactccatcgcttaaatagaaaaactcatcgccaatatgtggtttaaacggcttaggtaaagtgcttgtgtcgaattttggatcaagtttttttacaaagaaccattccatggtcagattagcgagccatggttggatgatgccatcttccggctgcatcacaaactcgccgtttttagttttggcgataacttttagaggtaaatcaggattaccatcgcatagcactagcaaatcctcattacaagccttttccagcacttgttctgacgttagtttaggatcttcccacattccaatgatgtcatattccatggttgcccaatgtactgatttacctgttaagttccatgatgtcgtattaatgtaaataccatcaaatctatacccgattaacggatatacggtatctcttacctctagcttttcaacctcgttaagcaaattgtatttaacaacggcttttcctccatttctcaacatcacaggctcgccattcaaggctgcttttaagttaaattctttcattttctttctcctaaaacaaaaggcgctcacttggaacgcctattggatttatttgtttaaataattaatcattctttccccgatccacttaataaccggtacagccatactattgccgatagctttatagcgtgggctatccgggcaatcttcggctggtttatttcgatacgatatttgcgtataacctggaggaaaaccttgtaatttttcgcattctgaaggggtaagtttgcgaatgttttggttgatgctcatgcatggaatgttattcccacctgtccccattcttgcggtaagtgttggcgtagtgccgtccttttgtatgcgcacaacatcgcgtcgatctgaaatatcgaacaaaacattttcctgcccattattgcgccccaggcagtgggcagttgatgtggaaataatcgggtcttgcgtaccatgtactacaatagtttcagagccaccaccaagcgccccaccactagcttttactagcccccccaatacggattggcgatacgttccaaagcttccctcagcgtagcaggtaaaaccttgttgcgtttttccgcacgattgagaatacccttgcaagcttttgcgctcaaaaagtatttgggcgacgcttctttctctagcacttgccacaaggaacacgcgcttgcgtcgttgggcgagtccgaagtattgagcatcgaggattcgccacgcgatagttcgggacgaatgcacataaccagcgtttgaccatttagcccctgttggttgcagtggctcacgctcttgaaccaatccagccaaaaggtgtccgaatgcgttgtcttttgtggatagtacacccggaacgttttcccacaacaaaacgcacggctgcttaccgtcttggtatctaacataatcaatagcctctaatatgtgtattaaagttaacgtgagatttccgcgctcgtcatctaacgagtttcgcaaaccagcgacagaaaatgcttgacaaggagtaccaccaacaagcacatcaggcgcaggaatttcacggtttaagattttttcgggtaaggtggtcatatcaccaagatttgggatgttgggataatgataagcaagcacggcgcaaggaaaaggctcaatttcgctaaaccacagcggtttacttaagcctttccatgccacgcttaccgcttcaatccctgaacagattgaaccgtaggtaaacatagtgcggttattttttcctctgttttggattaatcacaggcaacacaggcacaatcggttttgctgttgtagctgttgttgatgggctactgcggttttcatttatccagtcaaatagttcctcccacgaatcgtagtcaagtttgtggaatgcgttatttcggtcgcttgcccagcgtttcagatgctcattaatatcgcgagtaattacctctcgagtattactgcttaacacgctccagtaggttttaacatcgtgaatagtttcgctaacgatataagtatgtcgtggcaagctgtatcggacgtgactaatcattaaattttggaatttatgtaaggggagtttgatgttaatttcattcattttcgtttgcttttctttttacgtttactaaaaatacgttcttgttttattgctctaagctcagtttcaagcgtcgcattttctcgttttagttgattgttctcagcttccagacttttaattaattcacccaattttcgtagcttcaattcatggagttcgatagatttatcaatatgtttatccaatcgtctaagatcgtctatcaggactttttcagctagccgtttaagtaatctcataatctatccctaatcccgccaaattcttttattaggctatccactgttttaccaagcacgctcgccattaagacaaagtctacatcaaaacgagcagttacatcttcttttacaatatcatcgttctgctcggtgatattgtcgtcaaatttcaggcgtttcagcgtgccatcttcgattaatacgaatttaaggttgttttcccactcaagcgcgagtttagagatcaagccattttgaacaagctcaataatttcctcgtcttcaacatctttttgcttgcagtgaataacgccaagatcttctttttcgcggatttccacttccttacgcaagattagccaatcaggtgcagtatctgtaacccatcttgtcattacttcacacggcgcacagttaaacgccaacggtactactagcaaactacctagcgatttgcgcaaaagtgcgagtgcatcctcagctgttttacttgatgctgcatcaacaaagataagttgtttcaacgtgtcgatgtaaagtgcggtcgttttgatgcgagaaaatgcttgcggaagtagagtagctatcacgtcatcttttaaagatgatcgttctactttctttaattttcgctgttctttttcttcaagtgcagtgattcgtttattgagttcacgattcacaacttccacaggcaaaatcttctcttctcgtttagctacaagtaagatttttccgttcgcttgatgtgctaaattttcgctggtgacgagcggagcagaccaaccgaaatggctaacatctgctgaaccacacggagtaaattcacattctttgagttgtttttcgatattctcaaagtctatttgttttgttaattggtaaataattgcatttctgaaccagtacatttttattattcctcataaataaaaagccgctaattaatagcggcagattttaagcatcatcttcgtagtagtgttcttcaaccacgaatctatcactaccatagacaggttctctatatggtttttagtcatctttaacctcaacaaactcaccaaattcatctaacgtgtaccaagtatcagctttgatgttattttcaccgacttttgatgctttgatatggattagctcgccatcatgattgcgatatacacaaacaatagcaccattaatactcgccttagctttagattgccaaccaagcgcaacagctatagattgcttgccagatatttccgctaccgactgatcgcctgtattagtcgctaccgaccgatagcctgtattagtcgctgccgaccgatcgcctgtattagtcgctaccgaccgatagcctgtattagtcgctgccgaccgatagcctgtattagtcgctgccgaccgatcgcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattggttgctgccgaccaatcgcctgtattggttgctgccgaccaatcgcctgtattggataccttggctgcatcccaatcaactttaccttttatccattcaacggctttttttatcatttccggtaagttaatttcggtttcgatcgtgatttttgcagatgcaatttttgtatcatcactatcttttgatgtttcgccgctcattttaactacagcaaatttacttaccgctggactgtaatagctaagcacatcaagcgggtattcgcaggcgtggaatccactctcacaagccttaacattacctttatgctcatacgttttgcctacctcatactgataacctcgacaagtccagtcttgcttaaaccctttataagctataatttctttgttttcttcagccatttttgcctctcaaatttagataataaaaaagccactattggttagtggcttgtggtgtaactcaaaacggaatatcatcatcaaacccatcttgttctgccgctgcgcttaatgggtcgggtttttctttgtctttgcttggctgttgtgtttcattgtttgccttgctgtctagcatttcaaaggattgtgtcgctactttaagtgcggtgcggttattgccgttttggtcttgccagctttcctgtaccagtttccctgttacacagatttttgagcctttttgcagatattgtcttgctacatcagcagaattgccatgcaccacaataggtatccaatgcgtacgtttaactgtattaccttgtttatctcggtaatcatcaccgatagcgagattaaatgtggcaatttgcccaccattttggaattggcggatttctgggtcactgcctaaatgaccgactaatatcacggtgttggtattacgtgccattagcgcatctcctgtataagttgttgataatattcttgagcaatttctactcgttctttgattttctcgatgactttctcatcacgtttaattgtgacggtggtgatacgtttttcttgggggatttgctcaactaagtcaatgtatcgacttgggtcatcatagcttgataattggtcgtaaggggtggggaggaggacaaaatcaatttgcgcctcactacaatcccatagccacatatagccttgcatttgtgcgtcataccccgcttttttggctttttcttccgcctcatcagcaaaaaaagggtgtgagccaatatcccaagaacatttagtatctatgattaattttcggcttggcacataaatatcgcactcgcctgtaatccaatcgttttcacgtctttccgtgttctttttaagaggtaatccacgtttacgaccgcttaacttaatggcttgttcttctagtgcaatgcctttctcggtgtatttattcccctcaaaatctcgataaccgaataaatcaaatttcactatctttctcaccgcactttttgctgtagcagatattccattaccgcttttaggctttaccattaaatcagccaagccagagcatttagctttgagttggtacatttccattctcaatcgcctccaactccgcaatctgctcttggctaaattcataagccccactatcacaaagctcttgtagggtggtttcgccgttagcaatgctttgtttgcattgttcgaatgtggcttcatcaacaaccgctaaaaattccgcttcttgaatattgtcggtgtagttgaactcttgattttctacatctttcacaacggcttggtcggctaatacggcttgttgcatttcaacagagagtggagcttgttttgatagcaataacttagttacagtttttaatgccattgcctcgaagttatcgtgccatacgccatagccttttttgaatgtttggctgtagcgttgagcgtgtttgacgatgtcatcgtgactcatatagagttcagccgaaaaatcgtttaccagtttaaaataggcgtaatagccgattggattttcgttttgttcaggctcttgctcccagtcgaactcaaaaccattgatgaaatcttttttgataagttgctttttgtacacaggcaatgcgactaagcgtttaaattgcccactacgctgtgccagttggataaagcctttatagccaatttggaattgcgcttcggttttcttttccttgttgtttctgaaagggacgatgtaggcaaagcctaagccattttgtagtggcaaattcaatgtcgctgccatacaagcggcgttaaaaatgctcattgggtctgctgttttaagcattgcattgctattggcaatttgcataacacttgttgcaaaggttgccgcatttttgccaacaagttccttaatcttattttgcacattcgcactttcaaaaaatgttttaagtgcaggtggctgtttattttgttgatgttggacttggtttgtcatctcgcccctccattaatctgggtcataatcattcattctgtcgtgcaattcacgctctgcgattttcttaatcgcctcttgtctataaggctcataacttgcaccgctaccaatggcaagccagaaattatcgttatcacacaacatttccgtgagttcgtgataatgcgtttggtcgccttgttgtaaatcattgtcgatttccgtggcgacttcatctaaagcgatttcatagcctgcttgccaatccactttacgttggtgtgcagcatcgagttgatagtagtaatcatcggaaggtttcattgtttactccaagtgcggttaatttcggcttgcttttgtgcggtgtaagcctgcagttctttttctgctgccagtgtaagattaggcggtaaacatacaccgttttcatatatgccccctttcagttcacatcgggtttcttgttggatttgttggcttaattcgttatcgtgccaatcggtggggtgggcattggcgtgtaggctaatcccacccacaatcatggcaataatcaaggcggcgagaaaatagcagattctgtttagccatttttcactgcctttcataaagtgcgtgaagctttgtttttcttggcgtaatggggttttcgagtgtttcatttggggctccttgttagatattaagcattttttcttttgcgattttgcagctgtcttttttgatttcaaagccataggacgggcggttaagctctcgtgcggcgcgtagcgtggatgcactgccagcaactggatcaatcactacatcgccctcatcggtaaagatttcgatgaggcgttttaacacggcaatgggcttttgtgtcgggtgcagtttagggatttccttgcggttgtccttttcccattcgaaccagtttttaatcattttgccgttgttgttaaatttcggcagtttatcgcggtataaaatcaaggcatattctgttgcgccgacgactttcatattcgctttgagcacctgtggtgatgatgatttaataaacaccaaagggatgtgatttttaaagccgtgctgcttggcgtaatcaatcaccattgagatttgctggaaagcgcagaacacaatcatacaaggggctttgccgcgttctttcggttctttgatgagcatttttgaacaaaaatgcataaattcggcaatgcggaaatctttatctgtatcaaaaaaactactgttggctttgtcgctttcgccgtttttgttatcgccgtttacataccattcagggtttgaagcgtaagcattattaccgagattgtagggaatgtcggcgatgactagctgcgcttttgggatgtggtagcgtttgtagttttggaagtgatcgttgaataattcggttttcatttttgtttcctttttagtcgatttgttgaattttgggtgtaataatccgccacacgatttttcaaaagtgcggtcggattttttgctgttttatagaatttctaattgaaaacccgtttttttaggatcgtaggcgcgaagatattttaatacgcgccagttatttccttgctcgcattcaaattgctctgtaatgcgtgtcaatacgttatgggcgtgacggagagtactgcgatattcgtaagctatgtcataaacggaagcagcgtagtgcgaaccaatttgttttagtgcggggtgaagcacttggcaaagttccgtgccacgcaataaagcaaaccacgcccacgccattgtttgcaattcgtgttcggtaaattcaaacgtaaatgttgtcggttcctgcgtggcaatattgggggattgattttcttccatatctttctcttttttacgttgatttatgccttctttgagttttacaaaggcggaaaaggtgggtttaatttcatcattgagttggtgatactgtaatttctttcgccaagccatttcaacacgtgaaattaattcgagattttcaagggtgcaatttcttgaattgccgtctttgtaatcaataatatgtccacgcggaatttttctaccggctttgcgccagagataatgcgatttccgttcataacgtttaatgcttgcttttattaaccaacattttgcatttttacaatatcgctcaaagccaatcggttttaaattttcacctttctcaaatcgacctcttcgtcccggttagccattgtctcttcacgcgcaaaacctttaacgcgtgtggattaaatggtttattgaaataaacttccattttttgagccaagattctttcatttaacgtgcaattcgctttaatgaacgcaagttcttctttgctgtaacgattagcatgcttaaggcttggaatattgtgtttcttttttaatttatagaaaacattacgatttattaataaatcaaactgttgctgaaacaatttaattagatcagatggctttttatcccaatgtaagcgaataaacgcaatatgttcatcggtgaatttaaatcgttccgcattagaggtcatcgccttgcgccttagatattcttagaaaatcaggggattctctttcaatttgacgattttcaaacaatgtcattgctttaagcgaaatcgcattgcttgcgataatatttgccgcaatgcctgatacggcattggcacgtttaatttctcgattaagttcttcatcggttaagtcttcatcaagcagtttttctaactgggaaaataaatgattgtttaagtctgtgattttatttttcattttaaatacccttaaaaaaccgccctttcgagcggtcagtggagtagtgcaatcagtctatgctgattttgtctagaatagagtgcctttctttatgcttgtaaggctcaagccgaggctatcgtattaattctcttacccctagtctgcgcttctgcactgcgtgcacggtgtttgtaccagcaggtttacctttgcagcagtggtagttggctatgtcgataaattgctctttttggcggttggctgcaaatttaattgcgcgatccgccgcactttcttttaccaccattttttcaaacgcggcattaatgcgacgttgtttatcgaacattctttctaatctgcccgctttaccacgttgtaaaatttcgcctttttcggtgaatttgcgtgaacctgcatcacgctttacgatgatagttgccatagttggctccttgtttgtgtaccatttttaaccgcgctttaatgtgataatgcgcttaatctgtcagattccgcaacgcggtcgccgtcaaatcgatttcggctgcattaagagaaaagtgcggttaaaaatggcgttatcttgattgcctcagccccacgcgttcaagttacgcattattcccaatgttgatgttggttcgtgggtgattcgatttgttaaagagcaattaaaatttttattcaaggccttctcaaagggcttagtaaaaactttaggcgataaacttaagtgactgttcttatttttcttcttcttttattaaatcccactgccgtctctgcttatctctcggcttacgcctgctattgcggtgggtacatttttaaatatgtgctacaacttgttttgcctctacttcaacttcatccataatcagatttctgaaatcttcattagtcataaacaaatctgctaaggcttctaaggcttttcctgttttctctgcgtaacgctctaacacttcggtaatgaaaaaggcttttaattctgctgggctattaatgttcatgttgggttccttatgggtgtttgttttgatgtgggtataatatagttttttctattctgtgtaaatagttttttctataaaaatatagtttttttgacttgctgaaattttaggtaataaaaaagcccgcgattgcgggctgggtgggttgtgtattgcgttattttttcttcactctaaaattttcatcatcttgacaatactcaaggcaatcacgaatgataccgctcaatcttaagatgttttcagggcaatctataataatttggctgcctgagatttccaaaccagcgcgcacgatctcctttctgttctcgtcatttagctctataggaattacaatcgatgggcgttgcttgttatcgtaataacgtaagatccagcggttcgtttttccttgatacaaaatgctgaaatagctttcagtgtctttggcgatcagttcaacttcttcgcctagaattaatgaaacatattcagataataatcgctcagtataggttgtcacgattttactattgttaggatcgacgacaggcgcggtttcatcaatcatctccgatgctggctcttccaactgctccattaccggctgcttggataagcctgatacaaccatttcgctcacagctttctcaactgcctgcttcacgatnggggtaatggattcaataaaacgctggttaagctggcgtccaatattggaacgaccggcaatatatcgaacaaaatcgctatctacatctnttagagacgatgaaataaccttagtgaaagcggaaagataaacactttcttccgctaatgtgcggagtgcttctggttgaaacttatcgtggcagaattgcgctagttgtgggattttagtttcatcaagactgctaaagtttatgcgtaaaaatggtgtactatccattatatttttatctttcaagtcagtgaaaaatcgccattctttgccattggtaattgctgcaacggctacttcaggggttgcattaaaataacgcgcgagctgtggtgcatgattgcttaagtcttcattgtaggattttgcttcaataaacattaccggcacgttatgacaaaatagcgcgtaatccactcgttcaccattttttgcgccgacaaaatctgcagtatattccgcttttactttagttggatcgtatgatgtaaagcctaatatatccaagaatggaagaattaatgcttgcttggtagtttcttcggttgtgcaatgtggcccagcacgtaatacgtgttgggcgtgagataggattttatcttttaaaatggcatcagtcataatacattccttattgattatttcgctgatcttttggggtgtagtggaaatctaaatattcggctaatggtttaagttcagggataaaatcattattctcagccgcatcttcaattgctttttcttttttcttatctacgcccttatcaaggcaatcagatgtaatttttttactgcatttgctaaatccattggttatatacgctcgtcgtgcgacgatatatacgatcttatttaaaaatacttttgatgtatctacgccttttgttaaaaggttattataatctgcgagatattgatctgtaatggatttgatgacatcggcgcggaattggcaattgtctagcattggtgttcccgccacttctccggcaccttcacaaactaaatttactttatcgcttttatttaaatcgatcactttatcgtaagcagattttttaaattttgcttgtgtcgcgttgaagttaaattcattttttgatttaaatacaatatacgggtgatcgaataaatccgtctcaatgctacctatcgtgcctgaaactatcaaatttttgcctttgaattttttgttggctcgagcttcatttttatcatattccttttctaattcagatatggtggtaaatacgtaatcaccatatttataagcagttttcccaccttgaaagtagacatctatttcttccttgatcactaatttcattaattcaatttcttgtggacttggattgtagattttatcttcggcaagcgttgaaaagggtaatgcaactaagattagcgaggatagcacagcttttttcattttagtttccttgatgttagcgagagatttttggcatattacacaataggtggggatcattcagtgatatagatcacattttagaaaccaaacgcctaccgaagcagacgtttgatgaaagtttaagcgagaaaaatacacttattttgcgttagaagtagttttagagattgatgcgcggcgtaaagataagattttatcgttggtacactcactctcatttcccgccctacgtcaccttgcgataaattgctaacataccgtagcataaacacttgatataactctggtgtgacgttgcgcataataagtgttgcgtcgtgaatgcgcattgcggtttcatcatccaacatcgggatgccgtgatcgggcgtggatttgcgtaaaaaaggctgaattgcgggatagttaattcccacgccttcacgcgcccatttgccataacggcgagcagttaatttaatatctaagatgtgtttggtctgcatattatccctttcttttttctattaatcggcattttttgttaaaaatctgtttgatgcgccgtaagtcatcggggaaataatgccgtgggcggttgtcagcttcaatttgttcgactttttcgctacctagtctatcaagcaagcctaggcgatattgctgtacattgccgccgtagtagcggttgcattttttacattgaccgtggatattgagagtataaaagcgcaagtgtggcgcagctccacgtgagcggtaatgcccagcatcaaaccctcctcctagctgttctgccactaagggcgtgccgcaggagatacattccttgcccacatcgcgcaggcggatatatttatttactgccacttgcgcttccttggtcaattcgtgcttggttttgtttttctctttaagtgcggtcatttttttgcggttttcgattcgcgcctgtttgtcttttttctcgcgtgccttgcgggtctgttcgcgcgaaagtttaatggcacattccggcgaacagaccttttgcaagctagaaacgatttttataaagtagtttctgcacattgtgcatttatattctttcgccattagctaaccaccatattaaacattccccaaactgccccaataaaaagtatgatttttaactctaaaatctcgtcatcatttaatttcattttcatcctttacttgtgtgtatgcttgtgtataatttatcgtgattaagacgacaaggaggaagcatgcgatccagcgacttaatcaaggaacttaaaagtgcaggttgtacttttgtcaggcacggtaaaggcgatcatcaaatctggcaatcgcccatcacagggaagacgttccccgtaccgcatccaaaacaacacgtacccatcggcacattaagatccatcaaaaaatcggcagggcttctatagctctgccgagctaacccacaaggagcgactatgttattcactatcggcattgaaaccccaacaaacgaaaatgaagcctacggcattacggtgccagcattatttactgaagaatattcctgctttagtgccgctgatacccttgaggaaatcccaacgcaggtgactgatgccattcattccatcttagaaatgatgtttgaagacggaatagacatcaacgaacttcaagataaaggctatcgtcactaccaaacgcaagaagatttcaactattgcgatacttggttgttgcttgatgtagatatttccgcatatcaaggcaaacgccaccgtattaatatcagcttgcctgaataccttatcaaacgtattgatagccgtgttgcaagcaatccaatctacaaagaccgcagccactttttagcgattgcctcacaaaaagagctacggcaataattacccaaaaaacgcatacaactgatttaacgtattttcatcggttgtatcgttaaaaatatgcttgattgctgcactaattaacgctttgtaacagctttcaaactctgcttgctccatattcccataactcaaggattgcgcctcaatccgcaaatcccctttaatgttgtatgtagattcgtaaaatcccgccaataccgttagatgtttacgaaaggtgtcaaattgcttgcgctcatcaaagtgttcccattctgttttatctgcagcccaatggttaaaacagaatttaaaaaaggcgaacaccttacgatggaaagcgggattgcgtgtacggatgatttcaatttcatactgctcgccattttttaatgatttcaattcttctgattccagttcatcaagtggcgcaagcacaccgccttgtaacttaatcatctgaatttttaaccgcccttcagttcgtttcccgtgtgcttttttaatatcatcaacactacaagccattaacctatttctccatgcggatatacccactaacctttttaataaaatcaaggctaattgaacgtgtgacaaagtcttccattgttggatcaaagactacgaccatttgccctttgctattccccttgatttcttttcctgttacagggttgataaatgcaattcgaccacctgtaatatcaatcacttcatttgccacgccttgaatatggttttgataccattgagtagatttatcattgttgagtaacatcacgactaaataaccagcatcacataattctttcgcacgttgtagatatggtgtaacgttggaataaggtggattcacatagattcttaacggagccgaacaacgttctgcgacttcatccaacaatacatctaacatttgctcaatcggcattagaaagtcatctgcgattgattgatgctcatcattatctgagttaggctcgccgatatagtgacatgtcaaggcgttgttggctgtagcgcaaccatcaagatcgaaccagccgaaacgttgagatagccattcaaatacatagcacggtgtttgccatgtatttttatcaaattgttgttctgtcattgcaatgcccctttcatcattgccatcaagctatcgcgcgccttatcagccttcgctttatcgtaaaaacttggctttgctggaatcatcttcggaatatcctcaaaaggaaaattcgaccgcactttttccgccgcttctgtgagtaatttcggaatagctttcaacgtgtcctcttccgattttttcttgcacttttcgtacagatttttaagcaaccaaaattccacttttgaacgatattgaaattcatcccgattgaatcgggcatagcctaagaaagtgttataacgttggtataattccgcttcgttcggtaaacctagtgcgtgatagtcgtaggctttgcaccaataaacgaacaaccctacgctaggtaaaaatttatcaagcgatttttccgcttcacaaatcccgttctccaactgaggtctcgtaattttttctcgtaccaacacacgcaaccaagtttttttagcagagagataatccgcttcggtttcaaaggctgcacgccaaccaggaaaaattgatttaagctcgttaaagagccagttaatcgtctcttccgcacgctgtgctcgttctggtgggagcgtgttaatttggttttgtgttatggaatttgccattgcgtaccgtccactgtgaaattcattcctgcagaccagcctgtctgcgtatcgtcaaatttgggtttgttggggtgtgattgccctaagtgcggtaaatttggtcgcagtttttcatcacgccaatcccatgatgcgttaaatccctgccagttgcgttcaatgcaaatctccaccgcttcacaaatcgaaatccccgccttgtccgcttgtttttgcaggcggttgagttgcgtttggttaattacgccctttttggctttgcggtgtgcgataaaatctttcgccagttgtccggtaataccgaactgctcaagcaacatttcggattcgcttttttgcgtagtttttttaatatgatggttatctgatggttctattgatggttcagggttaagctcgtttactaggggtggtaaagctgctttactagggtggttaagctcgtttactaggggtggtaaagctgctttactagtaaaaggctctaatatttcccagttttcgggatgcaagatatacacattagtggcgttgccgttttcggttttacgttcacgaatggataaatatttcatcgcttccaatttcttaacgtgcgaaattgccgtagggcgcgaaacttcacattggattgcaatacgtttataacttggataacaaacgccatcatcattcgcattatcggctaattttaccagcactaattttgttaaaggattgccggttttgcttttaaatgctttagtcattaactcaacactcatctcataccgccataaaatacgctttatatactttgcctgtgcgtgcatcgtggacgaactcgtccgaaatctgatgccagcggttttttaaatctaaaattcgcgccgaaagacgcaagcaaccgaatttgtctaaagcttcgagtgatgtcagtcgcttacctgattgcaaataacgcaaaatacggtcacattgcgattgacttattttttcgtttggattagtattctccataaatacattccttaatgattagccacggttcccgccgtggtttttttattgctctaattcccactttaagcacaatgcgctttcaatgagcgcgtcaatgctggcggaaatcgtttgtttttctttgttggataactcgcgccctaaatctgaattaggatggactgcgcttttgatttgttcgccaattttccctgcattggtggtaatgtctaaaaagccttgcacgacatcggcgcagcaactggcgcatttgggcataggtacgataagatgatcgattttgtcggcaatggcggcgacggtgcgcgtgctattggtgatttcgatgagatcgagggcttcgataaagctgagatgattgttttcgcattctacgttaagtttattgcctaaaatattcggcgatttgcctagcgtgagtgccagcgtagtgataccgccagatgcgtttttacaatcgcgatgtaacgtgcgctgaatgtctttactgttcattaaaacctttcctttttcttgaagatttttactattcgttgcgctattgtgactttgtgagtgagcgcaagatgtcggtttcggtgacttttccattggatgctttggcgataagcgggatgtatttgccactaataccaccacggtgaagccaagcaaaaaccgtaggctgtgcgacactgcacagctttgctaatttggcttgaccaccacattcatcaatcgcaattttaattgttttattgatcaaaatagtctttcctattaagtaaataaagtttttactattctaaaggaaaataaactatttataaataggtaaatctatttttttatctatagaaatatctataaaataaaatagaaagggaaagggagtaaatatgacaacattgggcgagcgattgaaatttttgctgattgaaaggaatgttacacaagcagaattggcggaaatggtgggaactacccaaggtgcgatcagtaatatcgtgaaaggtgaaactcaaaaaccaagaaatattcttgagattgccaatgcgttaggtgtagatccaaactggttaaaatatgggagtacaaaaatgacaaaattatcagagagattaaaagcgttgctggtagaaaaaggaataaaccaaaccgaatttgctaatatgatcggcattgctcaaccctctatgcagaaaatccttgccggagaaaccagaaatccacgcaaaattgttgaaatagcaaaagagctcggtacaacgccggattatttgttgtatggcgatatgaccgttagtcattccactttggaaaattctcagatcaataacaatcaggggcagaccgtcaataatttttttgacagtggaagtgatgaattacgcgagatgttgcataagcagcagatttcattaaaaacgaagccaacggaagaatgggtttttgccttagatgtaaatcgtttagctgagacagatataattaatgtgcatttccctcgcccttttgaagctttgcacctttcgcaagatgggatgatggatttattgaaattacgctctacggcgaacgtggcgatgataacgatgtttaatgagagtatgtcgccggtaattaataaaaaagatttgatgtttgtggatacgacttgtaaacaatatgctggcgaagggatttatttgtttgtaatgaataatgagttgtatgtgcgtcgtttatatcaaacaccgagcggtgtattaaatgcggtggcggagaatgagcgcgtgggatcgagctttgaaattgatgatttgtcacgtttaaacgtactgggtcgttgcgtgcgaaaattttctattgttgcagaggatttataagaaaaggggaaatttcccctaaattttttgagttcccctaaaaaagtttcaaaaaatccttgaaatggctagctattaggtgtattattttatttatagtgcggttttagcacgttgagaacgcacaaaaaatatttacagccctgagcagaaatgcttggggcttttctgtatctgtaaaataggttttattatgccgactaaagatccgactaacttggaatcttttttacgctggctcccattggtttttatcggattatttgccggcgttgcaaaatacgcaagcgatattcaagcgggaaagctccactttagcgtggggctttttttatgccaagtgcttgtgtctatgtttgcggggtggattgggggattgatttgtctttcttccggtcttgatagcgatttagtttatgtaggctcagggctttctggttatggtggtggcgcggtgcttaatgccatttggcgggggttctttgcgtctaaattggggattaaagatgagcaaatttaagctatctgctgctagtgaagaaaaactagtaggcgttcacgcggatttagtgaaagtggtgcaccgtgcaattgaattaagtgtggtggattttaaagttattgagggtaaacgcacgttagagcgacaaaaagaattgtttgccaagaaagcgacaaagacaatgaatagtcgccatttaactggtcatgcggtggatttagtgccgttaccagtgaattggaatgatcgcgagccatttaagaatgttgccagtgctatgtttcaagctgctaaacaattgggcgttgctattcgctggggcggtgattggaatatgaatgagagttctaatgatgagcgtttttatgatggaccgcattttgagttattacggagtgtatatccatgacgtggtggctatttgttataaaaaaacttgggcttaacgtgtttagtcatggttgcaagcatttcaataaagttgtcgctgtatttgcaggagtgtttattcttgcgttgctttatatgcagcacacaaataagctcaatattgaacgccaatcagctgttattgattctctgcatgaaaaagtcattaagcgggataagattattgatgaattacacgaagatgtggacgagcaaagaaagattgccgaaaagcggttagcgcaagagcagttaatcagggagcaaagttatgcgcaaattcaatccattaagaaaatactggaaagtaatcagtgcagccgtactgtactgcctaacggtgttgctgacgagttgcgcaagtaagccagaaattgaataccgcacgcttgccttttcgccgccggtgagtttgcttgccccctgccctattccatcattccacggttcaacctttggggagacggtggaatatgcgttattgctcaagcaagaattgcggttatgtgcgaataaggtggacggggtgcgggagtatgtgaaggcgcgggaaagtgcggcggaaaattagaaagataaatgatgaataaagatttaaatattgaatatatttctacggatgttctaaagccttatgtcaataatagtcgcactcattctgatgaacaaatcgatcagatttgtgaaagcattgaagagttcggttttacaaatccaattttgattggcgagaataatggaattatagcgggtcacggtagattattagccgcaataaaactgaacttatatactgtgccgacgattagattaacgggcttatccgatattcagaaaaaagcctacgtgattgctgataactcactggcgttgaatgccggctggaattttgagctattaagtttagaattaaatgaattaaaagatctcggttttgatattgatttgcttggctttgatgatgattttttaaaaagtttagatggtgatttattggctgatataagcggtgattccaattctaaggaaaaacttgatcttaaacaggcgtttttagccccccctttctcaattttaaattctagagaaggttggtggcaggatagaaaaagaaaatggaaagccttgggtattgatagcggttcaggtcgcgatagcggtatgcagcgcggtatgaacagtatggcaaggtataactcgaaagaagatacttcaatgtctgaaagcgatgattcaatatttgatcctgtgctttgtgaaatactgtattcttggtttagccctaaaggctgtcaaattttagatccgtttgcaggtggtagtgttcgcggtattgtggctagtaaattaaatagaaattatatcggtgttgatcttagagccgagcaaattgaagctaatttgaagcaacgaaacttggtttgttctaatgatgagttgcagcctatatggatttgtggcgatagcataaatattgataaattagctaatggtgtctccgccgatttagtctttagttgcccccttatgccgatctagaagtttattctaataaccctaatgatttatctaatatggattatgataattttaaaaaagcgtattttgaaattatcaaaaaatcttgtgatatgttgaaagataatcgctttgcttgttttgttgtcggtgaagttagggataaaaaagggaattactataatttcgtaggagatactattcaggctttcttagaagccggtttaagctactataatgaaatgattttagttaatgtatgtgggactatgcctatgcgtgcggctacgccttttaaaggtagccgcaagataggaaaggtgcatcagaatgtcttggtctttgtgaaaggaaatcctaaaattgctgctgaatattgtggagatgtagacgtgtacatcccgaatgaagacaattaaccgtatttggcaatcaatgcttggatgccctgataaattaacttatcggggtctttttttatctggcggacaaaattagggtttgtgtaagccatttgcgctgatttaattgcatctttagcatttcccaatctaggaaatttacttgctagtgagattgcttttttccattcatttttagccatcaaatcttttaatacatcaattttcttcatcatatttatctccttagtgattattagcaactgtactttaatgtgtaagaatgtccagctatgagtaagaaaaaaacaaaacctaagattgagatagatttatcaatggttgaaagtcttgccgctcaggggcttactaatcaacaaattgcagatagcttaggtatttcagagagaacgcttcaaaatcgtaaaaaagataatgcagaatttgccgaagctataaaaaaaggcaaggctaaaggaattgcggtggttacgaatgctttaatgaagaaaattaaatcggggaacgttaccgcgatgatattctttctgaaaacacaaggtggttggaaagagaacaatcagcttgaaattgagatgaagaaagagaaaaaattgcctaccctggcggagttgtttggcgatgagacagaccctgattaaaccactaaagcccatgattaagtcttgccgttataagattttgtatggtgggcgtgggagtggtaaatcgtggggcgtggcgcagttattgattgagattgctgttcgtaccaaagtgcgggtgttttgcgggcgagaattgcagaactcgatgagcgatagtgtgattaaacttattgcggatacgatagaagatcttggctatctagaagagtttgaagtacagcgcaatgcgatttactgcttgaaaaccggctcggagtttatgttttatggcataaagaacaatccgaacaaaattaaatcgcttgaggggattgatttggtatggattgaagaagccgaaaacgtctctaatgagagttgggatattttaattccgactattcgtaaagagcgatctgaaatttgggtgacatttaacccgaaaaatattcttgatccgacctatcagcggtttgttattgcgccgcctaaaaattcgttcgttcgcaaaatcaactacgatgaaaacccttatttccctgaaacgttacgccttgaaatggaagaatgcaaagagcgtgactatgaactgtatcggcatatttggctaggtgagccagttgctgatagtgacaaggttatcattaagccggtatggattgaatgtgcagttgatgcgcataagaaattgggctttttgcctgccggtcgcaagattgtgggctttgatgttgcagatgacggcgtggatagtaacgccaatgcgtttgttcacggatccgtggtgttgcgtgttgatgaatggcgcggggaagatgtgattggtagtgcagacagaactcggcttaatgcattggaatttggcgcaaatgaaattgtttacgatagcatcggcgtgggtgccggtgtaaaagcacactatcatcgcctagacgataaatccattcgtattaatggctttaatgctgggggcgcggtatttgaacctgatgcagaatatgtttatggtaaaaccaatcgcgatatgttcgccaatattaaggctcaggcgtggtggcgtttacgcgatcgtttctataaaacctatcgggcgataacgtatgaagagcaatatcccgttgatgagatgattagtctttcttccgatataagggatttggaatatttaaaagcagaattggctcgcccttatgtggattatgacggtaatgggcgtgtaaaagtagaaagtaagaaagatatgaaaaagcgtggcattccgtcaccgaataaggcggatgcgttggtaatgtgtttcgcaccgaaagaagatgtattgtcgcgtttcattgggttaggaagttaatatggcatttaatcaagacggctacgccgaagccttggggattaatcattttgcaagaaattctgcaaattcaaccgcactttttgatttaacgttatatgagttaggtggtttagccgcacgggtggtcgatatgccagcagatgcggcgatttcacgttcgattgaaattcaaggcgatcaagatgatgcgattagcaatgagattgaacggttgaagattttgcctgcattggcagatatggtgcgttggtcgcggttttttggtggtgcggttatggttttattgaccgatgacggtgcgcgattaagtgagccgttagagccaagtcgcattacacgtatcgatgaagtgcgagtgtttgatttaagtcaaatttcgcctacggctaatcgctattccgatccaaccaagccaaattatggtcgctattccagttatcggttaaatatcggtacgattgctggttcgcttgatagtcaggtagaaatccatgaaagccgtttgttatttatgggcggcgattcattgccagaacgtctaaaaaatggcttacattggattgggcgtagtgcggttagatcggtttatccaaaaattcgtgattatcaaaaatcattgatgtgggcttcgttaattcttgaacgcaaacagcaagcggttcataaaatgaaagggcttgcgttggcaattgataatggattagagcctgttattcgagagcgtatcaatcttgttgaacgtgggcgtagtctgttaaatggcgtagctgttgatagcgaagacgattacaacattctcaatgcggatttaggcgggattgttgatgtgcttgatgaatttaaagtagcgatttcggctgatgtgaatattccagtggcgattttattcgggcagtcagctaaaggtatgaacgccacaggacagagcgattttgaaagctattacgatttggtcgaaagtattcagcaacataaaatcaagccagtgcttgaaaagctgattgagctattgatgtttcaaaagcatattaagccgtttgagaactggaaaatcaaattcccgtcgcttaatacaccaactgacaaagaaatagccgatgtgcgtaaaacgaatgcggatgcagcgaaaatcgagcttgatcgcttaattaatttggttgattcgggtgcgttatccacagaagaattgcgagtacagattgctggagagtttggcattcaagcggacaaattgccacaggtagatgacgatgatgttgaaaagtatcaagaagaacagaaagccaaaggtgtggttgtttcctcacgcaattgagcgtgaatatgtgggttatttacgtggtgtggcgagaaacattaatacgatggttaatcaaaaactcgttgaaattcgaccgcactttcaggcaaatattcgacaagatagtttttctgatacgcttgaacgttggcttattgaattattgcaagcagtattgatttttgttgatgaaaaagaaattacgcagtttgtgcgtggctatattcatcagacggcgaattttaacggcaagcagtttcataaagtgctgaaatcagtttatagcgtcgatgttttcacgactgaaccttggcttgatgatgcgttaaaaattgcggaatgggaaaatatccgcctaataaaaagccttcctacgcagacgttagaaaaattgcgtagtcgctttactcaagcggtgcgcggtggttggcgttgggaaagcgtggtagatgatgtgaagtctatccttaacaccaacgagaaacgtgcaacattaattgctcgtgaccaaattggcaagttaaacggtcatttgacgaagttgcgccagcaaaatatcggcgtgaagtcgtatatttggcgcggtatgcttgatgagcgtgagcgggcgccccacgttgatcgtgagggtaaacaatttgattgggataatccacctgatgacggacatccgggggagcctattttatgtcgttgctatgcggaggcggtattccctgaatttgaagatctaaacggtgtgatttatgcggagtaagaaaaatggtaatgcgatacgaccgccgtggcattcaggcacggcgagatgataacggttttatttatgacacccctattctgacaagaagtggggtgtttgtttatgagcttcctaatggcaaaactcggcgtgaatatcgtccgcctgatgaagtatttaaggcggatagtttacgcgcttacaagggattgccgattacagaagatcatcacggacttgtgacgaaaaataatgcgcatttggtggtgggctctatcttaacggaaggtaaacaagatgggcaaaatttaacggcagatattgtgatccacaatacgaaagccgttgattttggaaaaaaagaattgtcggttggctataaggtagatattgacgagacgagcggtataacagaagacggcgagccgtatgatgtgatccagcgtaatattcgtcctaaccatttagccattgtgacagttgggcgtgcaggcaatgccgcacttaatttagatgcggcagatgccgtggaatttaacgaagatggagaaaatccgatgagtaacactcaaacaacgctttctgacattcgcttagatagcggcattacgtatcaagccgcgcccgaagtgattgtggaattaaataaactcaaacaagacgccaaagatgctgtgacggcgaaagacaaagaagcggcgcgcgcagatgcggcagaagcgaaagtgaaagatcttgaagcacaggttgaacaaattaaacaagatgcggtaagtcaagccaaggtgcgtgttgaattagaaaacgtagcgaaagcgcataaggtggaagtgaaagctgatagtaccgaccgtgcgttgcgtgaagcggtaattaaggcaattcgtcaagacaatgcggatttatcgcaaaaatccgatggttatattgaagcagcgtttgatattgcggtaagcgatgccaaacaacgagcggatgcggcaggtgtgcagcgtcagcaattaacaccatcagccacaaatcaacccacattcacgcaggatagccaaacgaaattaactggtcgagctgcgatgattgcaagtcgtaaccaataggagcataaaaacgatgtctatgtacgatcaattacaacaaaaagcctttgctggtatgaaaggcgacagccgttacgatttagtcgaaacctttgcagcagaaaatgaaatcccattcggcgtagtgattacgcaagggacgagtgccacacaagctaaattaggtggcactaagcccattggcattgcgttacattcccatgctgtagtaggcggttatgcgaaatttgatgcggtttccgtattgcgtaaaggggttgcgtggtgtgtagtgaaagacagtgaagcgattacggcaggaagtgcggtaagttttgaccccgcttcaggcaaggtggcaaaaactggtacggcattaccgaatgcaacctttaaaaccgccgtagtggattgcggtaaatatggcaagctcgcattagtcgagttagcttaattattcaatgtttaacgatgccctaagtgaaaacttggggcttttttattggagaaaaataatgacagatattcgtcaagatgcatttgagttgaatgcgattaagacttgtttaaatgcggtgggtgtatttaaccaagatgcgggcttgtttacgcaacgccaattagagtttgtgcgcaacaaaatctatgaagaaaaattaccgggtatgaatggcttatcgctcgtcccagtctcttctgaatcccctgaatgggcagaaaccgtgactgaacgcatttacgatatggtcggcatggctaaagtcgttgccaactatgccgatgatttaccgcgtgcggatgtggcgatgacagaacgtgcagtaaaagtgaaaaacatcggtgctgcttatggctacaatctacaagagttgaaagcggcgtcagctaatcaaacggatttaccgtcttctaaagctcgtgcagcgcgtcgtgcggtggaagtaaagatgaacgaaattgccttgttaggagataaagaatttggtttaaacggctttattaaccacccgaatttaggagaaacctcggtaactggtggctggaaaactgcaacggcggatgcggtgctagcggatttggacaatctacacgataccgtcgtgttgcaatcaaaaggcgtgcatcagccaacacacttattgttgtcgctaacagattatcagacgttatccagtaagtatatgaacacggctgacaaagtggacgtattgacgttcttcaagcgtaaacatcctaacttaactattcagggcttatgggaattagagaaagcgggtacagggaataaaaacttagcgatttgctatgaaaaatcccttgataacttaactcttgaaactccgcaagattttacccagttaccggcacaagaacgcaatttagagcttgttgtgaactgtgtggctcgtgtgggcggcgtgttcttacgttatccgttatcggcaaccaaagcggagatttagcgatgattgtacgtaatattgaagcgcgtttaattcgtgttggcggcgagtttatcgcccctaatcaagaggtggaaattgccgatgatgcggtagggcttgatcgtttaattgaacgtggcgtattaattgacgtaacgccgaaagcggaagatgcgaaaaaagacggcaaaagtaaaaagcaggagtaataaatgagcgcatactcgttacttaatctcttttacccattaagccaacaaatgcctgaagatatggtaaataaggtgttaagcgtggctgataataaacgtccagactgtttatctgatgaaaagcaagatgaggcggtggcgtggtatgcggcttatttgttggctcagtcgattgaaagcggggtaaatgcggcaggtttacgacgtgaacgtgagggcgatttagaacgtgaatatttttcaagcagcgataaaggcggcaacgctgaacgctttttggcgaagtataacgagctaaacaatatttgcgtgcgccttggtgcgattaccgtagggagtcattgtgtctagcgtggttaaggtaaaaatcaacaataaagggcttgaaaaagaacttgagttgataaacaaaatcggcaaagcacgcgtaaaagtaggcgttcaagcggatgcaggcattcattctgaatcaggcgaaagcttggtggatatcggtatttggaatgaatatggcacggcacatatcccgtctcgtccttttattcgtcaaacctttgaagacaaccaacaggcattggcgcaatacttagggcgtgtggtcgagaatgtggcgaaaggggatgatttggtgcaagagctttcaaaacttgggcaatggtatcaagacaagcagaaaaagaccctaacgtcttatccttggacaccgaatgcaccatctacgcgtaggcgcaagaaaagtagtaaaccgctcgtagatacctcgcaattagtcaattcaattcgttataaggttgaaatctgatgcagatattttcttctcaatcttcttttcgcaagccttataaaatacttgtgcgttctgacggagagtatgtgaaaggcaagtgggtaaacgacggcgaaatcgagcagacgttaatggcatccattcagccgttaagcagtgctgaaatggatcgcctagtggtatcaatgcaggggcggcgcgtttcaagtgcggtaaaaatttacaccgatcaaaaactaacggtggctggagaaaatgcacacaatgtcgcagtagtgctatttgacggcgagcgatacgaagtgatttcacgagctagttatcacagtggtgtgttgtcacatcatcgctacgtggctatacgggtaaaataatatgcttgagcgtttgtatgatttattgggcgatctatcggatcgcccttttattcgcgcctatgaaaatgggcgtgagccagaaaagccattttttacttatgaactgaagtttgagaggacaccagaacattttcattattcggcggtaaatgatgaaggcaatcagacggtaaaaactcatatcgatgccgtgcttgagttgaattatttcggtggaaacagtttacaggcattgcgagatgtttgtatgcgcttatctatgcagtcttgtcgtgagcgttggttaaatgatggcgtggcattgattcgcattgggcggattacccatttagcctttctaaatgaacagcgtgaatatgaagatcgggcaatggtagagcttgaaattcgttatgcggctagtgtgcaggatattgtgggtattattgaacaagtggaagtgacggcaaatataggacgtgcttctgagaaaaatttaataggggtaaataaaaatggcgaaaattgatcgcttggtaaatgtggctattgatttaaatacaaccacaatcgccggtaaatcttttagtgatttattaattttaggcgaacatacgctgaataattcagcacgtttgctggtagtcaccgatccaaatgaattattggatttaggcttaaaatcaaacaatccgctttatatcgctgtggctaccgcctttgcgcagccgtcacacgtggcacaggtatttatcggacgtaaagcacaagatgaaagcgtgacggatgcgcttgctgcggtcgcacgagaaaataacagctggtatggcttggcgttggtctcgcgtgaagacgctgatgtgatgttggcggcggcgtgggcagaaaccaatggtaaattatttgttaccgcctctgctgatgaaaaattgccacaatcggcggagaaaaccgatattgcgagcaaacttgaagcgaaacaatattaccgctcggcggtaatgtattcccataaagcaacggaagaatacccagaaattgccttaatgagctattccttcacattctatccggggtcagaaacgtggaacttgaaaaaacttgctggcgtatcttattcgccgttaatggaaggcgaatacttagcttgctcgaagaaaaacgcaacgacatttgagaaatttaacgatagctttgcggtaacgcaaggcggcaaagtcgcagctggggaatggatcgatattatccgtttccgtgattggttggtgcaggaagtgcaaattaatgtgacatccgtcttaatcaatgcttacggtaaagtgccttacaccgataaaggtattcaattaattggtgcagcagtgcgtcaggcgttagatttaggtgtagcacgtggcggtattgcgccgacagaattggatgataataacaaggaaattccaagttatgtgatttcccttccactggcggcaaaggtatcgaataacaataaaggtaagcgtttattgcaagatgtgaaatttacggcacgtttagccggtgctattcacttgacagaaatcaagggcaatctggcttacagtctttaatcattaaccgaccgctaaagtgcggtcattttttaggagaattttatggctttagcaacttatgcgcccgatgaagtaagcattgtgatcggggcgagtattgtttctggctttgcagatggaacctttattgatattgaagaaatgtctgacggcgtatcatctgttgctggtgcagatggcgaagtagcacgtgcaaccagtgccgatccacgtaaaaaagtcacattaacgttattacaaaccagtgataccaatgatgtgttaagtgaactctatgcagcggataaagtgagtaaaaacgcaacctttccaattgcggtaaaagacttgcgtggtcgctcattattcgctgcaagcacggcgtgggtggttaaatcggcgaaacttgagcttggaaaagaagtgggttctcgcgagtggacgcttgaaactgcggacggtaaattatttgtagggggaaatgactgatggcacgcagtgaaattcaaattggcgaaagcactttttttgtgcaaaagttttcggtaatggatcagttacgcatttttggcgatttgcagaaaacccttgtaccgtcactggcgaaagtaatcggatttagcgatgaaaaaccgaaagatgcaacgtcagctcagttagccgaattagcacagaaaagtgcggcgaattttgcgcaaggtttacaagatttaagccagcaattaagcggccaagagttagttaaactagctgatatgctaatcaaacctgaactagtgacggtgcagcgtgatgatttcaacaatgggacagataaaaaacttagcaaaactgattttgatttggtgtttgatgatatgtcggagcttatcgagttggtaattttcatcttacaacttaatttcagcagtttttttacgaaatttcttgcccgtcttgggtcggtgcaagagcttgtgaagaaagcgtaagcgttggtaaatacagcgaacagacgctaagtgagatgatcgcttggcgtccttttttagccggtaaagttacactaacagagcttaatacggcaggattgacggatatgggcgagcttttgaagattaatcgcttactagatgcggtagatgcgatggaagcaaaacaaatggagaaaaaccgatgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattctgttgggctaatggtgctgggcggtattctctccgctgtatgggcgttattttccccattccgtgcatttttcggattgttgaaaggtggatttagatccgtaatgtttgtagccaaaccttttattaaggtagcgaaagggattgcatctccatttatctgggcgcaaaaacattttaaattattttcccgtgtcggcagtggcgcattctcgctgttgaaacgtggggcggtcaaatttacggtttatgggttgaaagcctttaaatggctcgctataaaaggtatcaatgggttctttggtattttgcgtgcggcggtcaaatttggcgtgatatttaaatctgtcgtcggcaccgtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctgggtaaaaaagtgcggttgattttaaccgtactttaaaaaaacaaaaccccgaaacgttaaagcatttcggggttttctattattgtgtgattagcttatgcagtaaatcgcttgcctgttgtatatcttgctgaatgtttttgttgaacacaaacagatagctatctccatttggaatgctggaaaaaaagaactccacaaggcgtttttgatcttccagttgtgcgcctgtaatggcttgctggaagttggcatattgtgatgcgtaagttaccatttttgccattgcctgtttaagttcatcactgacaagcggtagtgtaagttgttttggctcgttacggtgcattgctaagaacgcacgtaatacgatcaaatggaattttgggctaatccacattgcgtaggctaaaacaagttcttcgcaagcgtaagtgccgccttgagtgccgcgaatagttttaaatgcgcagatctgcgcatttagatcttcgtcttgaatttctttaattaattcttgagtggtttctaagcggataaattgatttgggcggtgtttctcttttcgaccgctagcaacgtgtaaatcgtttaaagagaaaagattttcgtatgaacgaatagaattgttgagaatggttaagtttgacatatctgattttccttttgatggaacccctaattttaggttagggcgatcgacagctcaaaactggtcagataatccagcggacgtattcccttgcggtattgtattagtcgcactgtcgatcattgaataaattgttaatttttgctccgcacttctaatgaattaaataatggtggtttaactcactaaaatttggatacaaaaaaatcacactaacggggtgaaaaccgtatctgataaaggtttttgagaccttaaattaatcctaatgaaattctcggccattgtaaagagaaaaaagtaaattatgagcatagtaaaccttttattttcagcccttgcgggcaagcgtacgacaattggtgtattggaattggacgcacttttaaccgaaaacacatcactttctagccaaatcacggaatatcccattgaagacggtacggtaatttccgatcacattacacgggaaagtgagcggttaagccttagtggtgtgattactggcacaggaacattgtttaatgttggcttagggaaatataaattgattgcagcaaaagagacgttgcgagaattacacgctaagcgtgaattagtgacgattgttaccggtcttgatgtgtatgaagattttgctattgaaagccttgagattgagcgcaacagtgatgacggcgagcggttaaatattagtgcggaatttcgaaaaattcaaaaagtgacgttacgcaaggaagaggtgccaccagagaaagccgcgccaaacgcaaaaggcaaagcgggacagacgaaagtaaaaaccggcaaagcacaaactggcaagccgacaaatacgcaggcacaaaaaatcacgaagtttggcgaatggactggtaaaaaagaatgatcacaataaaccttgcaaataaaaacgattttattaccgaagtaaatcttgatgatgaagtcttttttttacacttttcttggaacgacacaatcggattttggtcgctcactattgaaaatgcttataacgatgaactggtctcaagcattgtgattttgccgaatcgtcctttaattgcaccagtgcgtcgtgatgaattaccacttggagaattgattgcggtgcgtgatgataatttacaaacgattgggcgtgatgattttatcaatggcaaggcggtgttgatttatatcggagtggatgaatgagttatcgctttttacgtagttataaattgatgattggcaagaaagggcaaaaagatgccattgtgattgagccgccaatgcgtattgagttcgatattgaaaaagattgtgaagccgagccgaacgaaaataccattaaaatctataaccttgcatccactacacgaaaaactattgagcagccggatatgcggtgcgtgctgtatgccggttatgcgcaggaaggtgacgtgttgttatgctctggcgatattgccacggcatattcgtatcacgaaggcgcagattgggtaacggagctttatgttttagatggcttggtagaaattcgcgatacggcggtttcattaggttatgtcggtggcgtgagttctacgcaaattactaatgatattgctgcaaaaatgggcgtaaccgtagttggtgcagataatttgaaatcacgcacttgggcaaatggttttagtttttacggtgccgcacgtaaagcgttagacaaagtcgttgcaggaacggggcttgagtggtcgatccaaaatggcgaactgcagattgtaaaccgcaatggcgtgacaaagcgatcgggttatgtgttggcaaaagatagcgggctaatcggttttcctgaacgcacacgtgaagcagcacgcagtaagaagcaggatacgccaaataaaaagaaagatgagaaatttgcctttgatcggcaagcgagggacggttggaatgtaaaaagcctgttactgcctatggtaaacccttgtgacaaaatcaagctggaaagtgtgacggtaacaaattggttccgcgtggaaaaaatcaagcattcgggggatagtcattctagcgattggcaaagcgaactacatttagtagatctaaacgcaccgactaaaacgcagatggaaacgcaaagtaaacatcgtaaaaaacgtaagaaaaaggacgattaaaaatgacggatattttaaccgcactttctgaaattaatgtgtcattacctggaaaaattgttagttatgatgcggaaacggtgcgagcaacggtacaaccctctattcctaagcggttagccaatggcgaagtattaaatgcaccgcagattgtaaacgtgccggtaatgttccctatggcagacattaacggtgcggtagcacaagtgacattaccagtgaaagcgggagacggctgcttgctgattttttcgcagcgatctctagaaaattggttaagtggaagcaatgatgcgccagatgatccgcgaatgtttgatttatccgatgctttttgtgtaatgggcggtaatagtcgctctccaaatgccgatgttgagaacctttgtattaaatacggtagcggtaaaattaaaatcgcaccaaatggcaatattacgatcaattcgcctgatgtaagggtaacaacggataattttactgtgactgcgacaaccagcacctttaacggcaatgtaatcgtaaatggcggtatttcaacggcaggtaacagtggcagtgtatccgttagtggttctttaacgacaactggcgatgttatggcagatggtgtgtcattacaaagtcacaagcacaaaggcgatagcggtggtacaacagggaaaccattatgatcgatttaaaattgagtggacaacacgatttgatgataaaagatcgtaaactagtacttgtagatggcatcaatcaaaaagcacaacagattaaggttgtgcttttaacgtttttaggagagtggtttttagatacaacaattggactgccttattttgatgaaattttgacaaagaatcctgataacgcacgtattcaatccatttttcgcaaaaagattatgggtgtgaaaggggttctagcggtagagcgtttatctcttgaatttcatctaaaagatcgggtgttggcggtgcaattttcagcacgaaccaacgaaggtgtagtaaaagacaaagtgagtataaaacgaaatggctaattatggattaacgcgtagtggctttgtacgtaagcgtatgccagagcagttaaaagagctttatgaaaatgcgaagaaaatgtttggggaagatattgatttgtcacctgaaactgtgatgggaatgatgttaaacattgaatcagaacgctttgccgccttatgggagcttattgaaagcgtttatagtgcaatgtatccgattagcgcaaccggagcaaatttagatcgagccgtttcttttacaggagtcactcgtttacaagcagaacattcaacggtgccagtgattttttacggcaatgcaggcgttgaaatcccccaatatactgcagtacgcaatgcaggaacacaggttttatattattcagatgaagacgcacgcattgattcaaatcaagccgcttatgcacggattgagctaaattcaaataccattaatacgggcgatgtattttccgtcgtagttaatggtgtgacgtatcgttttacagcaatgcgttcatcaagtgcgagtattattcaaggtttagccaatcaattaaaagcgataagttatgccgatgtgagtaatgataatgtaattattgagatttcggcacaatctataccgcacttttctatctccgttagccaaaatcttacgctttctcgcttaggcgtgcgttgtatgctttccactgaaagccctagtgaagataaagccgatattgggcaaatgattgaactggtaaatatgattgatggcgttgttgaagtgaacaatgttgttgaaggtgcatccggtcgtttagaagaaagtgatattgaattatatcaacgttatcatcgtggtgtttggcaaaatggagccggtacaattgattcactttatgccaatttaagcaaggtagcgggcgttcattcattgagaatttatgaaaacgatgcagatcagacgattaatggtattcctaagcgttcactgtatgcggtagtcaaaggtggtttagatacggatatcgcatcgacattattaaaatttaagcctttgggtattggcacacacgggcaaaccgaagttactgtgcgagacagtcaaaaccaaccgcacttgattaaatttagtcgtccgactaaatgttacatttggttaaaagttaccattgaaacctttgttgatgaagatgaaattgcgagagctggttacattgtaagtgcactcaacaatatcttgaaatatggtaaatcacttggcgtgggagcagatgtaattcatcaacgccttattgctgcttgcattgcggttcaaggcgtgggaaaagttaccgttcagataggtaaaacgaataatattaccgatccagagccaagataccaagaacagaatatcaccatcgcacctgatgaagaagcgattttcgatccgtctatcattgtgatgagttaggagaaaatatgaaagatattttaaccgcacttaatgatgattttaagcagttagggcgagagcgattactttctcaatttaattactcgcctaacttaaacgcatttttatcacttcttcttttaccgcatcacgaaattcaagcaaccttaaagcaaatgcttacagaaaggcatattgataccgctataggaaaacaacttgatggcgtaggcgatattgtcggtatgccacgccctttcgctagagtaaatggcgattggtatttcggtttttctggtcaatcaaaggcaaaaccctttagtcgagcccctattcgtgatttagccacgcaaactaattctagagattttaattatatgctcgatgagcattatcgacgattaattaaatggaaagttatcgccaatcattcacatggcacccttgatgatgtaatcgaagcctgtagggctatatttttagcagagcgtgtttcaatcacagaaggacaggatgcagatgtgcatatagcgattacacgaatggcaaaaaatagattagatgcagtagaacaagagccggttttgtggattcccacggcagcaggtgtaaaggtaacggtagaatttataaacgcataaggataacaaatgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacgtagcaaacggtcaaaatctacccgaaaatggggcatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcgatgaaggagtgattaatgaaagtctattttttaaaagaaaatttgaatagttatcaaattttccctattcctcaaaacttaaatgattttgtggaaatggaagtagaaaacgaatcagagcttgagactaaacaacttattgattttaaaagtcaatacattctagttgatagacaaccaacagaattacacaaatggaacggaaacagctgggttgttgataaaaaaaagaaaactgaaattaagcgtgaactcattaaaaatctagttgatagcattgatgatacagcagctaacattagtgcaagatggacaaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagcttgcgtacattgcaacaacaattagcagtgcaaagaatgcgtaagtatgagttaaagcatgaggcgttgagtgatgaagaactgcaacgtattcatgacgatattataggtaaaatgcaaacattagcggaggcacaacaatgataggcgctaaaatctatctcgcattatacaaaggtaaaaaaacgggtaaaaacccgagcgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggcggtgtacgttgtaagcaaattgatgtttatgatagagaaaaatgggatttaattgagctagagggagttactgaagcacaaatcaaagcttattttgaccgcactttgggctgtaaatatgactggtggggtgcgttagggattgtgctaggcatcaaacaaaaacgctcaaaatatttttgcagtgaatggtgttttaatgcgatttgcggtagcgagagcggttggagatttagcccaaatcaactagcggctatatttaataaagagaaaagttaaaaggagcgtttaccctgcaaaacttcaaagggtataaagatttaaattgcttagcgagttggttattgttcagtgggcaacaagtggcaacgtttgatgacttattccaacataatttctggcattgtattcgtcagtctgattatccaaaggctgatggctatttggacggcgtagagattgtgaaagaatcattccacacgcttttgcctaagtttagcgatgatccgaaagcgttatttgtgttagatccgccttacctttgtaccaagcaggaaagctacaaacaagccaaatattttgacctgattgacttcttgcgattggtcaatatcacgcgaccgccgtatgttttctttagctcaacgaagtcggagtttattcgctttatgaattatatgctggaagataaggtggataattggcaggcgtttgaaaacgccaaacggattacggtcaatgccaagctgaactaccaagtggcgtacgaggacaatttagtctataaattttagctatgaaaaaggcttcgggtgatcacgaagcctttgttttagtcttctaattcggaaagcaagcaataaaacggtggggcgaaaggggcgagcgtggacgtaaatctcaccacgcaatctttgcgtccgtcttccacaaaacgcacatctaaaaatgccgtgttatagacaaaagtttgcccgcattcgttaggcagtgaatattgcgaaccgtctacaataaaaccgtcgtgttctttcactgcaataagggctaattccatcatcatttcctgctcggttctcatttgaaaatttgtcattttgtggtttcctgtgcttgtttaagttggtcacaggattactctcttcggcaggcatagcaagtcatcattgcggcaaaacgactgactgcggtcgaattagactgggggggtatggacggctaaataagtgcagatatgtaatgccatttcactaaatgaaaaaacaagaaaaggaaattatcttgcttttttaggaacggttatgttgtgcgggtttatctaaagtgtaaaatttaaacgccctttaatgatgatttaaagggcgttttgtctagatatatggcattaaatataatggtattatgaatggtattatataattatgtttcttttgaaaatttcgttttaaatcaaaatattatttaattaattctaatccagctagtcgcaccatctctatttttctctattccccaattttcagatagaaatagataaaatataagtaaaaacaatagcttatataatttcacacactaaaacataccttcttttttatatcaaaatcgcctaaaaggtagtatttttataccgattgggatcgatttcgatctgttctatactccattgcacatatttttgcacacgtgtattgcacacatttttatggaataaacaatggcgacaattatcaagaatggcaagcgttggcacgcacaagtgcgcaagtttggcgtgagcaaatcagctactttttttgactcaagcagacgcaaaaaatgggcagaaatgctcgaaaaacagctcgaatcaggaaagtataatgaaatccctgatattacattggatgaactgattgataagtatctaaaagaagtcactgtaaccaagcacgggaaacgtgaagagcgcataagactactgcgtctttctcgaactccgcttgccgcaatatctttacaagaaataggaaaagcacactttcgtgagtggtaaaatcaacgattaaaagaagtctctccagcaacagttttgcgtgaacgtagttcgctttctgctctaatggccaaaacgattgaatgggattttataacagcccccccctaaaatatcttgagaaaccaaaagcaccagcgccaagaactcgtcgatataatgaacatgaaattgagcgtctgatttttgtgtcaggttatgatgtcgaacatattgaaccgccaaaaaccttacaaaattgcacgggggcggcatttctttttgctatagagacagcaatgagagcaggggaaatagcaagtttaacttggaataatatcaattttgaaaagcgcaccgcctttttgccaattactaaaaatggacattcaagcacggtgcctctttcggtaaaagcaatagcgattttacaacatcttacttcggtaaaaacagaaagtgatctgcgagtattccaaatggaagcacgccaactggatcacaacttccgcaagctcaaaaagatggaagggcttgaaaatgccaatttacattttcacgacacccgccgtgaacgattggcagaaaaagtggatgtaatggtattagccaaaatatcgggccatagagatctcagtattctgcaaaatacttattacgcacctgatatggcagaaggctataaaacaaaggcgggttatgatctgaccccaaccaaaggcttgagccaacggaattttttcttctttaatgaaaacttcatcgttttcacaacaaatccaccgatagtcattaagctgtaaccgtccatggagcattaaaaggtcaatttgtgacggttttaatggcgaaccgataggcaacatcaatagattagcttgatgttcaatttttgaacggttacagttattgacacaagtccaagcggctcgatgcgccttgtttgttcggtggtctccgaattaagtgcggtggaacccaacgcacttttcgctgatttaatcacccagttttttaatttggtgatgattttcttttctgtgaatctgttttttacccccacaattttcttacgaatctcaccgtatttattcggttcgcattcttcatactcaatacaaataggctgatcacaacgttttgtcattgcgccaccttgcgcaaactatcactcaacaaatcattttgccgtatttgcaaattaatgttgatccgaatattgcgccacatcgtatcccttattttgagtttgacacaaaagaatatgaagacttatcggtatttgcagatgccatccctaaacttacgggcattggcgtgcagatttcggaaagttgggtgtgggataaattagggattcctgaaccgcaggaaggttaggcgaaagagatttgaaacgccgtgggattgataagcctgacgacagttctgaatttttggtggaagtagaacgcccagcagataagcaaggtaatcgtgaaaagacggtagggtttaaattgcctgatggcacgatacgtgtgacggataaaggctttgattacaatgtagggcgattaaactacaagcctaatttggatctttatcctgaaaaactggcgcatgcgtttgcgaaggttgagatgaaaggtggggagtttaagcacgattttgagttgttggcaaagcatatggcggagatgaaacaaacgctcagcctagatggaaaaaaactcactgttgatcaaatgttacaggtgcgagatagtcttaccaaaaattttaaatttgcggcaggtgtcttgagtgcggaaagtaaggatttattgaaaagcaaaactggcacagtgtggctttctgatgatactttaattaaacagtttaatagccgtgatgggcaagattttggactggaaagctatgcacttttccctgatttatttaatcagcctgatattgttctacaagataatgatcgtttttattttatcaaaaactttgagaaacagcgtattttaggtgtaataaagcacttatctaaatttaatgaaatttttgtgctttcggcaagggagattaatatcaaggaagtagaaaaaatgaaaggtaaattggcagttatcaagtaaggctcccgatcacttacacacgctctcggacacctgagcaggacgagccacctcaagtaggctgcggcagggagattatcaccgcttttttaataactgccttgcatgaatatacccccttaaattttaaaaatcaacaattacttcctcaaatttttatgcgagcaaaagggcgatcgattcgtttgattgggttacatgtcaatttacccgaagaaaataaacaagaacaaatgagcctctggtgatataatctcgcggttttttaggagtcgataccatggaacataaattagaagatattattgcaatttttaatcaatgttttgaagaggaatacaacactcgcttagtcaaaggcggtgatgagcccatttatttacccgcaaatgatgaagtgccttataacgcgatttattttgcgcgaggcttttacagcagtgcattgcacgaaattgcccattggttagtggcaggcaaagaacgccgtaaactagaagattttggttattggtatgagccagatggacgttcagaagaacgtcagcgtgattttgaaaaagttgaagttaaaccgcaagcattagagtggattttggcaacggcggcaggtttccgttattttgccagtgcggataatttgaatggcaatccgggcgatacacagccttttaaacaagccgtgtatgaacaagtgaaaatctatgcggaaaaaggtttaccaaaacgagcggaaatgttacgcaaggcgttagtggcattttatggcacagaagatgaaattgatctggcgaagtttgatgtcgtgcgtatttaatagcagaaagtgagcaaaattgctcacttttttcagtcttaagcccccaattccctcctaattaaatagttcaatttttaatcatttcacacccagtatactgggtgttgtactctctttacagagagtacaacaaaacataatgctaaacaaaaaatgtttggttgtttcaattgttgattaataaatggacgatttctatgcgattcacaaaaacactttttaccaccgcacttttaggtgcttctatcttttcttttcaatccaccgcttgggcggatacgctggaacagcaattccaacaaggttctgaagccactacgagaggcgattatcaaaccacctttaaatttttgttacctctggcggagcagggaaatgcagaggctcaattgatgttgggcgtgatgtatgcaagaggaataggcgtcaaacaagatgattttgaagcggtgaagtggtatcgccaagcggcggagcagggatatgcaaatgctcaagctatattgggattctcatatcttttaggacaaagcggtgttcaagtaaataaatctttagccaaagaatggtttggtaaggcttgtgataatggtgatcaaaatggttgcgaatattatggcaagttaaatagaggggagctctaatgccaactttacaatgcgaattttggaatgtagggcaagggttattttcaagtgggcgtattcaaatgggagacgccccagcctttcattgggtttatggtttgcaagttcctcatcatggttcaaagccaattttagtgaataaaaataaaagattatccattcattcaatttaataggaaaacaaatgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgctaatgccaactttacaatgcgaattttggaatgtagggcaagggttattttcaagtgggcgtattcaaatgggagacgcccaagcctttcattgggtttatggtttgcaagttcctcatcatggttcaaagccaattttagtgaataaaaataaaagattatccattcattcaatttaataggaaaacaaaatgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgttcaagtaaataaatctttagccaaagaatggtttggtaaggcttgtgataatggtaatcaaaatggctgcgaatattatggcaagctaaatagaggggagctctaatgccaactttacaatgcgaattttggaatgtagggcaagggttattttcaagtgggcgtattcaagtgggagacgcccaagcctttcattgggtttatggtttgcaagttcctcatcatggttcaaagccaattttagtgaataaaaataaaagattatccattcattcaatttaataggaaaacaaaatgaaactcacaaaaacacttcttaccaccgcacttttaggtgcttctgtattttcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatattgggattctcatatcttttaggaaaaggtgttcaagtaaataaatctttagctaaagaatggtttggtaaggcttgtgataatggtgatcaaggtggttgcaaatattatggcaagctaaatagaggggaacgctaatgcctttattccgcttaccgcaataataatgcgaattttggaatgtggggaagggattattttcgagtgggcgtattcaaatgggatacgccccagtttcccattgggtttatgattatggcatgaattcaagtcagcaacttattcaaaatgccatacaaaaatataaaaataaaatcacaaataaagcgtctgagattcttaatttccttttcgctgtcaattttccctaaaatcggctagaatgcaccgattttattttcggtgacttataaatgatgaaagattccattattgcaaaattagaaagtttaaaagaacgttatgaagagctagaagccttattgggcgatgtttctgtaattagtgatcaggataaattccgtgcgtattctaaagaatattcgcaacttgaagaagtagtgaaatgttttaatcgttggacgcaattaaatcaaaatattgaagaagctgaaatattgctcgacgatcctgaaatgaaagaaatggcgcaaatggaaatcgaagaatccaaagcggaaattgaagaagtggaacaacaacttcaaattcttttactgccgaaagatcctaatgatgaatataactgctatttagaaatccgtgcgggaacaggcggtgatgaagcaggtatttttgcgggtgatttattccgtatgtacagccgttatgcggaaagtaaacgctggtgtgtagaaatgctcagtgccaacgaaagcgagcagggcggttataaagaagtgatcgtaaaagtaagtggcgaaggcgtgtatggccagcttaaatttgaatcgggcggtcatcgtgtgcaacgtgtaccaaaaacagaaagccaagggcgtatccacacgtctgcttgtaccgttgcggtaatgccagaattgcctgaatctgaaatgccagaaattaatccagcagatttacgtattgatacttatcgctcatcaggtgcaggtggtcagcacgtaaatacaacggattctgcggtgcgtattacacatattccaacaggcattgttgtggaatgtcaggatgagcgttcacagcacaaaaataaagcgaaagcaatgtcagtattagcgtcacgtattgttcaagcagagcaagaacgccaagccgcagaacaaacagatatgcgccgtaacttattaggttcgggcgatcgttctgataaaattcgtacatataattatccgcaaggtcgagtaaccgatcaccgtatcaatctcactatttaccgtttggatgaagtaatgaatggtaaaattgatgaactgattcagccgattattacggaatatcaagcggatcagttggcggcattgtctgaacagaattaatgataggggcatctgatttcagatgtcctttttaactttaaaaggaaataaaatgatcattgaaaatcaaaaagatgctgaattttcttctgctttcaaatcttctcaacctgctcaagcaagccgttttaaacgttggcttgcgagtatgattaatgggcttgtgctttgggtgatggctggtctcggttttgcattgggggattttgccggtgtagtggggatgattgtatatgctggttttcagttatatttcatgaaaacttatggtcaaacaatggcaaaacgctggttaggcttgcgcgtatttaattatcataccaatcatcctgttgaatttggtaaatacatcggtcgtgagattattgatattttattggcatggacaagtttcttattgattattagcggtattgttgcacttgtgcgtgatgatcgccgttctttaacggatttagtggctggcacgatggtgttaaaagacgaaaaataatgaattataaagaatggctggcacaagcgattgtagatttagcacaaaaaaatcccactgaaaatagtaaaattgatgcacttgtgcttcttcaacacgctactggcaaatcgcgtacgcaaatccttgcttttgatgatactgagattgatgaaaaagtgcggttaaaattgaccgcacttttagatcgtcgtctaaaaggcgaacctatcgcttatattcttggtgaaaaagaattttggtcgttaccattaaatgtttcaaaaagcacattgattccaagaccagacacggaaagtttagtggaaaaagcattacaaattgcgttagaaaaactggaagaaaatccaccgcactttcgtattcttgatctcggcactggcacaggcgcaatcgccctcgctttggcttccgagcttgagcccatttgccaaaagcggcatattccgctggaaataattggtgttgatcttatgcccgatgttgtggcattagctcaatctaatgcagaaagaaatcagctaaatgtagaatttttgcagagccgttggtttgataatataacagggaagtttgatcttatcgtcagcaatccgccttatattgatgcgcaagatgaacatttgcatcaaggcgatgtacgttttgaacccctttctgcattagttgccaatgatgcagggtatgctgatttacgtcatattattgaattagcatcgagttatttgaattctaatggcgtattattgcttgaacacggatggcaacaaggagaaaaagtgcggtcaattttccaagaaaatcattgggaaatggttgaaactgtgcgtgattatagcgacaatgagcgtgtcactttaggtttttggaagaagtaatgaaatattatcgacgtgcgttatacgataaatttgtgcatttttatcttgttatctctgatgatggcagctcagaagcacaacttcggggaaaaatgggtgggcttgtgcgtaaagcgcgtaaaaaaatttcgccagattggccgaaagaagagcagattcatcagttactacagctattttatggtgattggggctttcattgcgatccagaagattatttttatgctcgcaatttatatttgccttatgtgtttgaacatcgtcaaggaatgccagtgactcttggggcaatggtgttttatttagctgaggcattggatttgccaatttacccagtaaatttcccaacacagttaattttacgtgctgaagtcagagatgaagtggcttttattgatccttgggatggcacttatatttcacaagaaaaattgcagcaactttatgaaggtgcatttgggtttggggcgaaaattcaacccgaagaacttgatagagccgatctttctttactttattctcgctttgagcaactggcgaaaaatgcgcttattcgtgaagagcataacgatatggcatatcactatattaagaatttaatgattactgatgctgaaaatccttatcatatccgtgaccgtggcttagttttagctcaaatgggggcttatccttcagcattgaaagatttagaattttttgtggaacattgtccaaaagatccaacggcggcgtttatccgcacgcaacttttagaacttaaaggcgagattaataaagatacttttcccctccattgatttaaggaaaatttatgcaaaataaaattgtaaaaattggcaatattgatgttgcaaacgacaaaccttttgtgctttttggcggaatgaacgtgctggaaagccgtgatatggcaatgcaagtgtgcgaagcttatgtgaaagtgacagagaaacttggcgtgccttatgtatttaaagcgtcttttgacaaagcgaatcgttcatctattcattcttaccgtggacctggcatggaagaaggattaaaaattttccaagaattaaaagatacattcggggtaaaaattattaccgatgtacacgaaatctatcaatgtcagcccgttgctgatgttgtcgatattattcaacttcccgcctttttggcgcgtcaaacagatctcgttgaagcgatggcaaaaacaggcgcagtgattaatgtgaaaaaaccacaatttttaagcccaggtcaaatgggcaatatcgtggaaaaaatcgaagaatgtggtaatgataaaatcattctttgtgatcgtggaacaaattttggttacgataatttaattgtggatatgcttggctttagtgtaatgaaaaaagcctctaagggtagccctgttatttttgatgtaacccattcacttcaatgccgtgatccatttggggcagcatcgagtggtcgtcgtgcgcaagtaaccgaattagcgcgttcaggtttagcagtaggcattgcaggtttattcttagaagcacatccaaatccaaatcaagcaaaatgtgatggcccttctgcattgccactttctgcgcttgaaggctttgtttcccaaatgaaagccatcgatgatttagtaaaatcttttccagaattggatacctcaatttaaatttcatcaaaagtgcggttaattttgaccgcactttgtatataaaaaaggagcaattaatgaaaatcgtatttttagatagcacggctattcctaaacatatttcaattcctcgcccaagttttgaacatacttggactgaatatgatcatacgtcttctgccgaaaccattgagcgagcgaaggatgcggacattgttattaccagcaaagtgatttttgatcgtgaaactttgcaacaactgccaaaattaaagctgattgcgattactgcgacaggtacaaataatgttgatcttgtggctgcagaagaaatgggcatcgccgtgcgtaatgtgacaggttattccagtacaaccgtgccagaacacgtaatcggtctgattttttctttaaaacacagtttggcaggttggttacgcgatcaaacggaagcaaaatgggcggaaagcaaacaattttgttattttgattatccaattacagatgtgcgcggttcaacgttgggcgtatttggtaaaggttgcctaggaacagaagtggggcgtttggctaatgccgtgggaatgaaagtgctttatgcagaacataaagatgctactgtttgccgtgaaggttatacgccttttgatgaagtattaaaacaagcggatattgtgacgttgcattgcccattaacggaaacaacaaaggatttaattaatacagaaaccttatccaaaatgaaaaaaggtgcatttttgattaatacagggcgtgggcctttgattgatgaacttgccttagttgatgcgttaaaaacggggcatttaggcggagcggctttggatgtaatggtaaaagagccaccagaaaaagataatccgttaattttagctgcaaaaacgatgcctaatttaattatcacaccacatattgcttgggcgagtgatagtgcagtgacaacattagttggcaaagtaatgcaaaacatcgaaagaatttgtacaacaattacatcaaaaataatgaattttcctatttctctttatattgcactacgttattggcgtgcgaaaagtgcggatcgttttgggcgattagtaactaatcttgcaagcctggggattgtgctaggtgtgatggcattgatcatcgtgctttcggtgatgaatggattagaaggttaccaaaaacaacaggtgctatcttccattcctcatgcgattgtgagcgaagaacagcctatttctacagaaaaaacgctagaaaatttaccgcactttgtccaaaaagccgtgccgatcaatacaacaaatgtgatttatcaaacggcaaaaggcgtaagtgcaggacaaattataggtattcaatcattttctgatgatcctttggttgaatcttttgatcagactaaatttaatgaaattttgcctagaggggagtttaaactggtcattggtgatcaactggcgcaaaaactgggcgtgaatattggggataaaatccgtttgatgattacggaaaatagccaatatacaccattcggtcgggtgccaatgcagcgtttatttactgttagcgatatttattatggttatggcgaagcatctggttacgaagcctttgctaatattacagatattggtcgcttaatgcgtattcaacctcagcaagcgcagggctatcgtttatttctgaatgatccgttccaaattacagaactcccacaacatttcccgacacaaaaaatcacagattggcgtgtgcaaaaaggcgaatttttccaagcagtgagaatggaaaaaaatatgatgggtttgctgattagtttgattattgtcgtggcgatttccaatattgtcacctctttaagtttgatggtggtggataaacaaggggaaattgcgattttgcaaactcaaggcttaacaaaatcccaagtgcgttcagtgttcatttatcaaggattactggtgggatttgttggcacattactcggtgctattttaggtgttttagctacgttgaatttaacggacattgtaagtgcggtaaatccacaaggtgtttttttaccgacagaattatcctttgttcaaatgatttttgtcattggattttcgctgttactttccttgctttcaaccctttatcctgcttatcgagctgcgaaagtagaacctgcagcagctttgagatacgagtaaatggtaaataaatgatggatgaacaatcacttttagcttttgatacacaacatatttggcatccttattcttcagtttcttctgatatgccgctttatgcggtggaacgtgctgatggtgtgatgataactttaaaagatggtcgtcgtttgattgatggtatgtcctcttggtgggcggcgttgcatggttataatcatcctcgtttaaatgcggcggcacagaatcaattagcaaaaatgagccatattatgtttggcggatttacccatgaccctgcggtggaattagctcaattattggtacaaattttgcccaatggattagataagatcttttttgctgatagtggttctgttgcagtggaagtagcgatgaaaatggctattcaatatcagcacgctaaaggagaagtacaacgacaaaaatttgccactattcgttcaggttatcacggcgatacgtggaatgcgatgtcagtgtgcgatccaaccacagggatgcatcatttatttcatcatagcctgcctgtacaatattttcttcctcaacccaacattccatttaatgaatcttggaatgattgtgtcattgaacctttagctgatttacttaagaaaaaaggtagcgaaatcgccgcactgattttagaacctgttgtgcaaggtgcgggtggtatgtatttttattcgccaacttatttagtgaaagcgcaagcgctttgtaaacaatatggtgtattgctgatctttgatgaaatcgccacgggatttggtcgaacagggaaattatttgcagctgaacacgcaggcatttcgccagatattatgtgtatcggtaaagcattaacgggtggttatttaactttatcggcaagtattacgaccactgaaattgcgcaaattatttgtagcggtgaggctaaatgctttatgcacgggcccacttttatggcaaacccgttggcttgtgcaattgcagcggaatctatccgtttattgttggaaagtccttggcagcaaaatattcagcgaattgagcattccttaaaacaacagctttcgcctttagctgaaaaagattacgtcaaagaagttcgtgcattaggggcgattggggtggttgaaatgaaaagtgcggtaaatatgaaaactttagttccacgttttgtggaacaaggtgtttggattcgacctttcggaaaattggtttatgttatgccaccatttgtgattaaagatgatgaacttcagaaattaacggaaggcatgattttggctttaattcaggaatatgaacattaggataaaaaatggatgctttcaaacagcaactggaacagcttagcgcacaaaatcaatatcgttcaattccagatttagttcatcaaggacgatatattatgcgagaaaatcgcaaaatgctgaatatgtcatctaatgattatttaggtttggcatcaaatgaaaacttgcgccagtcttttttacagcaatacggcggtaatttcccctcttttaccagttcttcatcgcgtttattaacgggcaactttcctatttataccgatttggaagagcttgtcgcacaacgtttccaacgggaaagtgcgttattatttaacagcggctatcacgccaatatcggcattttgcctgctttgacgacgaaaagtttgattttggcagataaattagtgcatgccagcatgattgatggcattcgtttaagccaatgtgagttctttcgttatcgtcataatgattatgaacatttgaaaaatctgcttgaaaaaaacgtcggaaaatttgaccgcacttttatcgttaccgaatctgttttcagtatggacggcgacgtggcggatttgaaacagcttgttcaattaaaaaaacaatttcccaatacttatctttatgtggatgaagcccatgcaataggcgtttacggtaaaaacggattaggtattgccgaacgagctaatgtgatagctgatatagatttgttggttggcacttttggcaaggccttagcttcaatgggggcttatgtcgtctgtgatcaaatattaaaagaatgtttgattaatcaaatgcgcccattgattttttcaaccgcattgccgccgtttaatgtggcttggacttattttatttttgaacgattgccgcaattctcaaaagaaagaagccatcttgagcggttaagtgcatttttacgccaagaagtggaacacagaacgcaaataatgccaagccaaacttgcatcgttccctatattttaggcgaaaacgaagcaacccttgctaaggcgaaagatctgcaagagcaaggttattattgtttgccaatcagaccgccgacagtaccaaaaggtacatccagaatacgattgtctttgacggcagatatgacaatggatgaagtgaaacagtttgtggcatgcttataaggaaataatgtgaaaacgaaattttatgatcatcaaggtgagcatttaatagtttattttgctggctgggggacacctcttgatgctgtagttcatttgattttgccaacagatcatgatttattaatttgctatgattatcaagatttaaatttggattttgatttttccgcctatcggcacatccgtttggtggcgtggtctatgggcgtttgggcggcagagcgagtattacaaggaatcaccttacaatcagcaacagcagtgaatggaacaggtttaccttgtgatgatagcttcggtattccctatgctatttttaaaggtacgttagataatctcacagaaaatactcgttcaaagtttgaacgtagaatttgtggtgacaaagtatcttttgaacgttatcaacaattttctgcacgaccatttaacaaaattcatcaagaactcaccgcactttttgcgatgattcagcaggataaacgcacaaatcttattcactggacaaatgcatgggttagttctcgcgataaaatttttacgccagccaatcagaaccaatattgggcatcccgttgtgccgttcagaaaatagagggtgagcattatgtgttttcaagatttacccactggtcggcattatggaatcattaacttccgtaaataaatcgcgtattcaacaagccttccaaaaagccttaaatagctatgatgaacatgcgttaattcaacaaaaaatgaatattaagttaatgatgcatttgcaagactatttaccaaatgggtcattagatagcgttttggaactaggttgcgggtctggtatgttgagtacgttgttgcagaaacagatttcagccaactattggttatttaatgatttgtgcgatgtgcgcactctactcactgaaaagctgattcaaccctttgatttttattgtggtgatgcagagaactttccttttcaacgacgatttgacttgattgcaagtgcatccgccgtgcaatggtttcaccaacccgacgcttttatcgcccattgcaaaacaggcttgaaaacaaacggattattggcggttgcaacctttggcgaagacaatttgaaagaagtccgccagatcacaaatataggattaaattacccgactttatcccaatggcaaaattggttagccaatgattttgagcttttatggtgtgaggattttaatgtaatactagactttgatacaccattggatgtactcaaacatctgaaatataccggtgtaacagcgactaaccaaaaaaattggacaagaaaaaatctcaatggatttattggcgattacttgtcggcgttcagtatgccgtcggacaaagtgcgcctgacttatcatccgttattttttatcgcacgctattctcacatagaaaatcagtaaggaatatttatgggcaaggttatttttatatctggcattgatactgatgtgggaaaaacgattgccacaggcatttatgctaaaaaattgatggaacaaggctgctccgtgattacacaaaaaatgattcaaacaggctgtaaaaatatcgctgatgatttacttgtgcatcgaaagattcaagacattgatttaacggaagaagatttacaaggcaaaacctgcccttatgtttttgaatatccttgttcgccacatttagctgcaaagcgagaaagtagaaaaattgaagcaaaaatccttgaaaaatctaccgcacttttggcagaaaaatatgattatgtactattggagggtgctggtggcttaatggtaccttattgtgaagaagagacgacgttggattatatccagttaaataattaccctttaattttagtgacatcgggaaaactaggcagtataaaccatacattattaagtttagaggcttgtcgtactcgaggtatttcagtattaagtgtaatgtataacggttacccagaatatgatcctattattagtcaagaaacccaacgctatttaaaacgttatcttgaaaaacattttcctgaaacaggatttgaatactttgggtgtattgaaatttaagctcaaggaaaagtgtgatagactcgcgcaagtttttgatgggattatctgccgctaaagtgcggttaaaacgagtaaaaaatgaacaactatttattaaaatgcgaaaatatcaataaattttatcaagagggcgaaaatcaaacgcaagtgttaaaaggcgtttctttttctatggaacctgcagagttggttgcgattgtggggagttcaggttcagggaaaagtactttattacatactttagggggacttgatcagccaagtagtggggaagtgtttattaatggacaatccttgcaaaaagcatcggctaatgaattagctgctttgcgtaatcgttatttaggatttgtgtaccaattccatcatttaatggcggattttaccgcacttgaaaatgtgatgatgccgatgttgattggtcatcaaaataaaactgaagcgaaagatcgcgctgaaaaaatgctaagtgcggtgggattaagccatagaattacccatcgtccttctgcgctttctggtggggaacgtcagcgtgtggcgattgcgcgtgctttagtgaataatccatcgttagttttagcggatgaacccacaggaaatctcgatcacaagaccactgaaagtatttttgagctgattcaacaacttaatcaagaacaaaatatcgcctttttattagtcactcacgatatggggcttgcggaaaaattatcacgccgtttagttatgcaagatggtcttttgaaggagggggcgtgatgaatacgccgttttttattagctggcgttatcaacgtggcaaacaaaaaaatcctttagtcgcgttaattgcaaaattctctgcaattggtattgcattgggtgttgcagttttaattgttggcttaagtgcgatgaatggttttgagcgtgagcttaatcaacggattttggcagtcgtgccgcatattgagattttttctgcgcatcaagcgaaagatcccacaattcatcattggcaaaatttagaaaaacgcctacaacaaaatccacaaattaaaggaatctctccttttgttagctttacggcattggtagaaaatggctcaaaattgaaagttgttcaggtcaaaggtgttgaaaaacaagcagaagataaggtaagttcaattggcaattttgtacaagagcaaggttggaacaaatttgagaaagaaggcggattggtcttgggagcgggtatcgctaaagaacttgatgtaaaagtaggggattggattaccttgcttatttctcagcaaaacggcgatgaacaatttgctcaaccaactcgtgagccagtgcaagttaccgctattttacgcttagatggtcagcttgattatagttatgccttattgccgcttgctcaagcacaaacctttttgacttatcaacctgatcaaattacaggtgttgaattgaaattagatgatcctttttctgcgagaaatctggatttatcaatgcttaatgattatccgcagatgctatatatgcaaaattggattagtaaatttggttatatgtatcgcgatattcagcttattagaaccgtaatgtatatcgcaatggtgcttgtgatcggtgttgcgtgttttaatattgtttctacgctgattatggcggtaaaagataagcagggcgatattgccattatgcgcacgcttggggcgaataatgcgtttatcaaacgtatttttatttggtatggcttacaggcaggaatgaaaggttgtttaattggaattgtgttaggcattatacttgcattaaatcttacaacctttattcaaggtattgagtgggttatcggtaagaaattattatcgggcgatgtgtattttgtggatttcttgccaagcgagttacattggttggatgttttgatggttttagttgcagcacttgcattgagtttaatggcaagcctttatccagcaagccgagctgctaaattacaacctgcacaagtattaagtagccattaatttcgagagtacagcacaaaagtgcggtatttttttatcttttatttacttaattatttcgttttattcagcttgcaagagagttgtaaagatagtttaatagggaattcgtaggttttattctaaaaaaaacatatcgaactagtttactagtacaaaaataagtgtagattagctacataatgaaaacacaacatttgaaagtttgagagtgatatatggctaaagagaaaattgaaattgtcgtggcaaacgacgatacgcgaattgaaaaagtcgatcaggtgttaccacccattgccttattagaaaaatacccagcaagtgaacaggctgcggcgttagtgaagcaaactcgtcatgaggcacataatattattcatggtaaagatgatcgtttattagtcgtgattgggccttgctctattcatgatccgaaagttgccattgaatatgcgactcgtttaaaaccattacgtgaaaaatacaaagatagccttgaaattattatgcgtgtgtattttgagaaaccgcgtacaacggtgggttggaaaggtttaattaatgatccatatttgaatgatacttatcgtttaaatgatgggttacgcattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggtcctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaattgaaatataatctagatactagatagaagtgcggttgattttcaccgcacttttttatttgcttttaactacgctgcccatttcattttattgcgacgtttcatttgatgaatcgtattggttacggtgccgacaataggtaaatttgaccaatcttttgtatttatattttgtgttgtggaatccaatgccataaaaaggtaattgccgctatgcgtcataaattcatagacatgaaattcgttattttcttctagcacaacaagatcaccagaataaagatcgtcatttttttcgacgactaacatatcgccgctttcaattccccaagccaacatatttgggttagttatatgaataaaacaagtttgttttggacgtttgatacagtaaagatttaaatctaattttttgttgaatttaaggttatcttctatatcactgaaaaaaggcagtggattataagaaaaatccatttcatattgtgtagccaaagtttggttgttcattctcttatctcctgttaaataatatggataaataaccttttaccttgtttttttgtacagttaaattttactgatatttcatacagggtgtcaataggttaaataaaaaatttttttataagtatgtttttagagaatatctaataactttagaaaaaagttcacttttagagtgaaaaataataaaaatattttctttcattaaaattttacgctatctttaatcccccctaggtggattggtaacaatctgaagttaaatttactaaaagaaagataaaaatatgaacacatcacgtctatttagtctgttatttcagggtagttttggtaaaacgaattgccgctggcttggttcttggtattgttgttgcattgatttcagcaccattacaagaaaccattggttttaatcttgctgaaaaagttggcgtattaggtacgatttttgtaaaagctctgcgtgccgttgcaccaattttaattttctttcttgttatggctgcccttgcaaaccgtaaaattggtacgaaaagcaatatgaaagaaataattgtgctttaccttttaggcacattcttagctgcatttgttgctgttattgctggtttcgtattcccaacggaagttgtacttgcaaccaaagaagatgcaagctcagcaccgcaagctgttggccaagttttatttacccttatcttaaacgtggtagataatccattaaatgcaattttcaaagcaaactttattggtgtattagcatggtctatcggtttaggtttggctttacgtcatgcatctgatgcaactaagaacgtattatctgattttgcagaaggcgtatcaaaaattgttcacgtgattatttcttttgcaccatttggtgtattcggtttagtggctgaaaccttatctgataaaggtttagtcgcattaggcggttatgtgcaattacttgctgtattaattggtacgatgttatttactgcttttgttgtaaatcctattttagtttattggaaaatccgtcgtaatccttacccattagtgtggacttgtgtacgcgaaagtggggtaactgcattcttcactcgtagttctgcagcaaatattccagtgaacattgaattagcaaaacgcttaaatcttgatgaagaaacttattctgtttctattccattgggtgcgaacattaatatggcgggtgcggcgattactattactatcttaactttagccgcagttcatacactaggcttagaagtttccttcgttagtgcgcttttattaagtattgttgcagcactttgtgcttgtggtgcatctggcgtagcgggcggttcattattattaatcccattagcatgtagcttatttggtatttctgatgatgtagcagcacaaatgatcggtgttggttttattatcggtattttacaagactcaaccgaaacagcattaaactcatcaactgacgtattatttactgcggcagtatgtatggaagaagaacgtaaaaacgcagcataatgatgatgcaaataagagagcgggctatgcccgcttttttttatgtgattttatatgcaaagtgcgctctattttgatagacttctgtcacgttttatttccctacaaataggtaagaaaaatgaatcacttaattatttttgctcaccctaattcagtgcgtagttttgggcgagcgattgccaatcgtattgagcaaattagtcaagaaaatggtgtaaatgtattttttcgtgatctttatgaaatgaatttcaatccaattttatctcatgaagaattgcagaatgctaacaaaggtattattccagaagatattcagcaagagcatgattttattcttcaagcagatttaattacgttggtttatcccctttggtggatggggttcccagcaattttgaaaggatatttagatcgcgtattaagtcacggttttgcctataaaacggaaaacggcgaatcagtggggttgctaaaaaataagcaaatgcagcaatttattacgattggcagtaatgttgatcaatataaagaatttggtgtggataaatcgcttaatcattgtttgattaatggattattcaattattgtggaattgaaaatgtcgagtttgaattatttggagatattcatttaattgatgatgaggctcgtaaggcgatgattgaacttgctgctcaaaaaactcaagcaaaattgaccgcacttttaaaggaaaaagagtaatgtctgaaaaacaaattaataatttttcattaattagtcgattattcggtaatcttttttatcgttctccaacagataaagtactcgctgacgcatttgtttggttacaacaaaaaggtttgagtcaagtttgggcgttagatactgataaagaaagtgaattagcactgaatagcttgcaagttaaaatcgatctcaatttattgaacgaagagtatcaaaaattatttggtgcgaatgggaaagtgatgacggctatttcagcttatggcattgatgttgaagaatttgtgaattttcgccttgtacgcaatatgccagaggtggaaagtgcggatcattttgctttattattgctcactgcttcttggcttgaagataattcggattctttagtggctcaacaagaattctttgaaacttttttactgccttgtgcagcgaagtttttaactcaagttgaaacgcaagcaactttgcctttttatcgtgcattggcccttcttacacgagaaatattggcagcgatggcggatgaattggaagaagagtaggcaatattttgctttcctctaagtcttgaggaaagcaagcaatattttatagataggttacaaaatcttttgtatcaataatacggcattcacgttcggctttctccatacttgtgccaatcatgactaacgcaatcacacgatcttgttcacgacatccgaacgcttctcgtaatgcagtgccattaacccatttccctgaaatccacacattatcaaatccttgtgcttgtgcagccagttgtaatccataagttgcacaacctgcactcaacatttgttcccaatctggcactttagcgatagttggatcgatttttgctaccacgccaataaccataggtgcgcgatgtgctaggttttcggctttcatcaatttttcttccccaagatcaaattctacaacggcagctttaagtagcgtttctaatttatttaagctctcattttccattacaataaaatgataaggatgtaattttccgtgatctggcacacgcattgctgcttcgaaaatacgctcaagctgttctgcattaggtgcaggtacggtcaattttttgtttgattttcttgtggttaaaagtgtaagtgcatccattttattatcccttataagtaaaagtgcggtggattatagcatagtttttgacaaggctttgtgatacgctagtacaaattttttaaaggtaatttgtatgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattattttgaaggggcagatttacccgcattagattttattggtggggctatcagtcactttaaagatgcagggaaaccagtgatcgcctatgcagataattattcacaaggacaatattatttagcgagctttgctgatgaaatttatttaaattcaattggaagcgtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcagtaataattgaaaaagggcagaattaaatctgccctttcgcttacaaaatatacgcttcttgaatatgatgtggcttttggtcttcttctggtggaagcttcatataatctccataatattgcgttaagtgttcgtgatatccattcattacttgaaattgtcgtccttcaaattctttataaacaatgtgattaaaatattctttcggcatataagatttttgccaaccaccgtagtcagataatacaagaccaatataatcgcattgttttatcggatattttatttggaattgtgctaaatttttttgcattttggaaaataaaaagtggcttaatttaccaagtatcgttctttgcaaagtattttcttttgatcttaaccatcttttcttacaagaagaaaatcgaagtttaattcttcggtgctttttcatcagtgggtaaatgatctttggttcattcggtacaccatcgtagataaatatatccataaacatcgggctttttcttcccttagcatctgttatttgagtgcgacaatcgaaaatttttgccatttcaccggtatattgagcaagtatatcttctgccgtttccatattgtagtattcgtgagtttcttgaaaccaaacatcaacgaacctttgatattcatcacggtgcatataaacatcaatatcatcatcccaagggataaagcctttgtggcgtattgcaccgattaatgttccaccaccaagagaatagtgaatttggtgtcgctcacataatgcgtggaaataatctaatatattgagacaaacgagttgttgttctctgagcgttaattttttcattatttttccttgtttggtgtcaatttttgtaaaatgtggtgatagtcatcaaggttatccatttcaaatatatcatcactgttaagttgttccgtatagatatttaatttctctatatattccatcggaatggtatcccaataaagttttggattttttaaccgcacttcacttgtgtattctttgagcaaagttagaatgatatcgcaatcccgagttgtccaataagatacccctgacaagctagactggtttaatgatccaatctcaatacgtattacttgcccattactatttaaaatcggtagccattcattgtgcgttttagaacggataaccgtgaaatatttgctgtgtgatggtttcgttagaaaaatattacgattaagcactacatccgcatcaataacataacaatcactaaagaagtcttgtgccagagaaaaggaataaatgctgttatattcgcgatatttttcgttgtaaatcaaggtgcagtcatattttttctttagatactcgaattgttcgtgtaaataccctgtaacaatgacaatattgtcgatatttgcttgacgtagaaaagtgagtgtccgttctaagttaggtgtgccgtgaatatctaacaatgatttatgtgtgctttgtgtgatgtctttaaaacgactgcctaatcctgcagctaaaataatcgcattcatttttgttcccctttgtaataaagtgtaacgatcactcctgcacttaataataaggtgagtagtaaggtaatgggcttaattggctgtttatagagcagataaccaagtccaattgcccatacagaatatgtgatatttaatgccattgctttgattggttttaacagataaatcgcttggtaatagcagcagtaagataatgcaccaaagattattacaccagcaatttgtacataattaaaactaagtatatctagtgagaaatttttcaaggaaagaataaatagaatcaataaataaccaatagttgaaccacatagtcttaaaaaatacacctgaagtccagagagagaacgcattgtataggaggatatcactatttcagatgaccaccctaatatgcaaatggctaaaaaaatgagaccgcttgtattgaagtttgctttttgcccgacttcaatagccaacaatgcagaagcaataaccgccaatccaaatccaaactgcgctgttctagagattttttcttttagaatccaataagacattaacgcagcgaaaacaggaaagagagatgaaagcggtgccgcataatagatcgttaaataatgaatgcttaataaataggcagacattcctattggcccacctaatacgccagataacgcaggttgccaaaaaacgccttgaaaatctaccgcactttttcgccataatgttatgccgataactaataacgagcaaaaatcaattaaaaaaagcaatgaaattattttccctaatgcatcatattcacttaatggcaattcattatataacaatccagataatgcccaaaatacagcggacagtatgccaaagagatagccacgcattatggcaattcctctaacagtttaaatgctgcgtctaagcgttttaatgcataatcgccaaaattctcgccgtgttcttcttttacttttgtccataaaaaccacaatacattttggcaaaagcgatggatttttaaccgtttgtgagcgatttgaaattctgtcttgtgatatttatttgtctgattgcaataggtttctaatagaaaatcagcagcttctttcgataaatgagcttcctcaatgatagtagctatatcaaatagcggatcatttaagcccgaatattcccaatcgataaaaaatagccgatcatcttgtaataacatattttcagggactaaatcattgtggcacggacgtaaaattatctctttattgatttcttcaaattgccaaaatacagctgaaagtttatccattctagaatcagcttgataaaaagcggatttgttttctagcaatgaaaaatattggcgaaactcatcgaatacgctaaatacattacggaaaacaaattcactattgtgtaaacgatataaattattcacaacttgagacaaacaactttgttcgtttaattgtatctggcttaaagtattactattttctaaataacgagtcagttttacgccacttttggcatctaatacgggagtttctacattcaagccagcacgatatgcctgagcattattgaatgcctcatattctcgatttataagtgataaatttacggcattagggatccgtaatacaaacttaactccagaaatattaagtagaacattttgattggtcattcctccaatggaggaaaaaggaatggaatgctgatgaagaaaatgaaatacttcttcaggcttgtagcaagttttaacaaatcctacaatttgattgattgattgattgattgattgattgattgattgattgattgattgattgattgattgcatagcatttttgtattcatttttatatttaaattttgtttgattttaacacgttaaagttatttttgtaaggctctgaatcttatgaatttattcaacttttgaacctttcaaccacttttttacccaagctcggttagctgaaagattatgtaatatgccttcgcttattggtaatggctcgccataaatgattgaagctaaggtttcgcctaatagtggagcagaggtaagcccgcgagaacctaaggctgcgattaagaaaatattctgaaaattggccgcactttggataggttgtttacggcggcggaggttaaatagattgtaataatccgcttgttgctgttcaaaatgaggcacgtttcccaccattggggcaagatctcttacagagcagcggatgcctacacgagcgagattatctgatgtattcacatcttgagtccaaggttgggcgatattttgttggagtttttgttggttttcttgttgttcttgttcactaaagtggcgatcaacattatcacgaacatggcttgcgccgatgcaatgtgaggtttttaattgattggctggagtaagatagccatcataacaaagcacagatttcagtttgagtaagttttctgatgttggaatttggctaacttgcccgcggatagggtagagcggtagcttttctgtttgaacaaaatcagtaattttatatccgttcgcaagaatgacgacttcatggcagtatttttgaccttgcgtattttctagttcccaacctttttcttgttgagaaagtgcggtaattttttgtgaggttttaatgattacaccttgcttttcaagaaatgaaaaggcattttgaacaaattgtcttggtgcaagccaagccccttgttcaatccaaccgccttcgcaattaagcggtaatcccactttttcactgagttgttcagcactcagcatttggaagatttcgttcggtaaaccaagttgagaaatctttgttaatttaaccgcacttttttcgttgtaagcacatagtgccacgccacaaaattcgtgctcaaactctatgttttgttcgatcgcccaatcaagtaattggcgaccgtagctaaaagcgtgcaggtaaaaatcaacggtgagcgcattatcatcgctaagttgcggataaaatgcgccttgtttattgcctgaggcattgagagcgagcgcatcatcttcacaataaatggtgacttttgccccacgttttactaaggaaatggctgcacaaaaagaagcgataccaccgccgataatagcgacatcttgtttttccattttcgcaggctgagcaagataccaaggtgtggaaagtacggtagattttgattgtatttttagcccacttaaacattcccgttttttgccaaagcctttacgttttgtcacattaaagcctgcggattcaagtccttttctaaccgcacttgctgcggtgaaagtggcaaaagaaccattgggttttgtgaaacgaaacattaatttatagagatcatcattccacatttcaggatttttgctcggcgcaaaaccatctaaaaaccaagcatcaatacgttcattcatataatcaccaagttgtggcaagttttctgatacattaccaagccataaatctaacgttgtctctccaaaatgaatacgatgacaacctagaatcaatgaaggccaataacgttgcaaatgagcgcttaaatcttcaaactgcggataggcaaggtgcgcttgcgaaagtgcggtgatttttagcggatatttttcaaaggaaataaaattaaggcgttttaaaggatgattctcgtgttgctggcgaaattcacggaataattgggttaccgcgaagaaatttaatcctgtaccaaatcctgtttcagcaatgacaaaattagcctcgttgtggcttatccaacgttcccaaagttgattaccttgtagaaaaacataatctgtttcggctaatccattttcgttagaaaaatagacatcattgaattgatctgagacgggaatatggtttcgattgaagtgaatctcagcatgttgcacgctaaaggtcattttattcctttcttgcctaatgaaatttgcgtataataacgcaattttctgaactggtcgaacaaatgaattattgcttgaaatatttttatttcgtagtaattttgtgccgttatttttacatataaaacaataaggaagaagcaatgagaagagctgtaattacaggctttgggattatttcaagtatcggtaacaacaaagaagaagtattggcttcattaaaagaagggaaatcaggtattgaagttgtgcctgagtttgtagaaatgaatatgcgtagccatgttgccggaacaatcaaattaaacccaagcgagcacattgatcgtaaagtgttccgttttatgggtgatgcagcggcttatgcttatctttctatgcgtgaagcgattgaagatgcaggcttaacagaagatcaagtttctaatgatcgtactggtttagtgattggtgcaggtacgggctctgcacataatcaattagtggcttgtgatgcggttcgtggccctcgcggtgtaaaagcgattggtccttacgctgtaacgaaaaccatggcatcaagtgtttcagcttgtttagcaacaccttataaaattcgtggtgtgaattattctatgagttctgcttgtgcaacctctgcacattgtattggtcatgcggttgaattaattcaattaggcaaacaagatatcgtttttgctggtggtgcagaagaattatcttgggaatgtgctactgagtttgatgcaatgggtgcagtttcaactaaatacaatgaaacgccagaaaaagcatctcgtgcttatgacgcaaatcgtgacggtttcgttattgcaggtggtggtgctgttgtggttgtggaagaattagaacacgcacttgctcgtggtgcaaaaatctacgcggaaattgtcggctatggcgcaacttctgacggttacgatatggttgcaccaagtggcgaaggtgcagagcgttgtatgaaacaggcaatggcaactgtagataccccaattgattacatcaacgtacacggtacatctacaccagttggtgacgtgaaagaattaggtgcaatcaaaaatgtatttggcgataaaatcccagcgatttcttcaactaaatcaatgacaggtcactctttaggggcggcgggtgcacacgaagcaatttacacgttgttaatgctggataatgattttattgcgccaagtattaatatcgaaaccttagatgaagccgctgaaggttgcaacatcgttactgagacgaaagaaaatgcaggattacaaactgtcatgtcaaatagctttggttttggtggtacaaatgcgacattaatttttaaacgttataacggttaaaacgattctatgaaaaagccactttcgattgaaagtggcttttttgtaaattaaaagaaaaattaagcaacgataccaaattgttctttcattaatgcttcaaagtcagtgcaaccaccaattggtttttcatcaataaagatttgtggtacggtttctactggcttaccaactgattttgataaatcttctttagtaatgccttctgcatgaatatccacataacgatagtcaaaatcagcaacttcgccttttaatttttcagcaaggttttttgcacgcacacagtaagggcagccaggacgaccaaaaataacaacgaacataagatttccttttttgagttaaacattctaggcaattctacctgatttttatcgtctacataaagtgtttttattcgtgtaatatacggaacatcgtagataataaattaaatgttatgaaattattaatgctttgccgcgaacctcgtctttatagttgccaacgcttaaaagaagctgctaaacgtcaagggcatgagatggatattttagatccgaatcgttgcctcttaaaactctcacaaaatccaccgcactttcagattttttatcaagaaaattcagggtctaaaccttatttattgcctgattatgatgcagttttgcctcgatttggcacaacaagtacacaaatgggatgctcagtcttacagcattttgaaggcaaagggactttttgtttaaatttatctcaggcatttttaaatgcacgtgataagtggaaaagtttgcaacttttgctgaagactggtgttcctgttcccaattcatttttaagtggcggtgaagtgcaagctcaggcgacgatacctcatatcagttcgccgacaattttaaaaatgctaaatggttcacaaggaattggggtaattttagctgaaaagccacaaagtgcggtgagcattatggaagcttttaagcaaactaatatatctatgttgcagcaagattttattgaagaagcgggcaatgcggatattcgttgttttgtgattggtgatcaagttgtagcaacgatgcaacgaatcggacaagatggcgagtttcgagcgaattgtcatcgtggtggaaaaactgaaaaaattatactaagcgatgacgagaaacagatagccattagagcaacaaaagccatcggtttagatgtggctggtgtggatttaattcgttcaaaaaatggattattggttttagaagtaaatgcaagcccaggcttagaaatgattgaaaaaacaagtggggttgatattgcagctgaaataattgattatattgaaataaatgcctttatcaatttaagataaaggcattttttaaaatattgtcaatttcaaccgcactttacgcgagcatatttacaactgcaaatgagactttcaataatgctgcgttgattaagtcgataaagaatgcacccaccattggaacgattaaaaatgctttgtgtgatggtccaaaacggctggtaacagcttgcatattagcgattgctgttggggttgcgcctaaaccaaaaccacagtgtccagcacttaatacgacggcatcgtaatctttacccattgctcgataagtaatgaagattgcaaaggcagccataaatgcgacttgaatagcaagaacaattaatacatcaattgctaaacctgcaagttcccaaagtcttaatgacattaaagcaattgctaaaaagatggataagcctacgctacctaatacgtcaatagcggattctgctacttggaaacggaaaatgttgcttaaaatattgcggacaataacaccagtgaataaacaccatacgaaagttggtaattggagtgcagtaccttttgtttgtacatctaaatattgaccaattaataaacatactgaaatcattgcaattgtttcaattaatgaacgtgcagtaattttacgtttataagttgggtgttcaaatgcttcttgaatgtcatcaacttcatcattttcaggattttcgccttgtttttggcgatttaataagaaacgagcgacaggaccaccgatgataccaccgaatactaaaccgaaagttgcacaggcaatggcaatttcagttgcaccttgtagattaaattgatgtgcaaatgtatccgcccaagcagctccagtgccgtgaccacctgttaaggttactgaacctgcaagtaaaccataagcgggatggattcctaatgccattgaacttgcaatgccaataacgttttgtccgaagattaataatgcagcaatgaatagaaatacaacgagtggctttccgcctttaattagacgggaaaagttggcacttaaaccgatagaagtaaaaaacactaacatcattgtggtttgtagatttttatcgaagttaaaggatgttccatcaattttgtgccaaattaaaagaccaatggcaacaataaagccgccaacaactggctctggaatgttaaatgtttttaatacattaatgcgtttaaccaaaaaatagcccaatagcaaaactaagcttgctaatgcaagggtttcatacgtgctaaaagtatagctcataaattggatctccctacgttatgtttaagtgatgtgttgtgttacggctcgactaccataatttcaagattggtatgtaatccacgtggtaatgtcgaaccttttctgcctcgttctgcgcggaacttttgcagatcttctggttttaatacaatttttcgttttccagaataaaattcaagacttgcttgatctgaaataagcaataattttgtcaatagttcgctacgatcttttgcattcgctgcgggaatagtgatcattttattgcctttaccttttgataataccggtaaatcttgtgctggaaaaatcaacattctgcctgctgatgtgattgcgacaacaagtgcggtagaatttatcaatgttttaggcttcaacactttggcattttctggtaaagaaatcaaggcttttccagccttgttacgtgcaattaaatcttcaaatttacaaataaaaccatatcctgcatcagaagccatcaataattcttgctgttcgctggccattacaacatattcaatggtcgcaccagtgggtaaattgagtttacctgtaagtggttcgccttgggagcgagcggaaggcaaggaaagcggatcgagtgcataactccgccccgtgctatcaatgaatacaacggcttgattacttttgccacaagcgtgagctagatagctatcgccagctttgtagcttaatgatttaggatcaatatcgtgtccttttgcacaacgtacccagcccatttctgataagatgacagtaactggttctgctggcgtcatatcactttcagagatcattttggcttcttcacgttcgaccagttgagacatacgtgggctggcatattttttcgcatcttcttgaatttcttttttgataagcgtattcaaacggcgttctgatcctaaaattgcttctaaatttaaccgctctttttcaagttcatcttgttctgctttgagttggttttcttctaatttcgctaaatgacgtaagcgtaaatttaaaatggcatcggcttgttcatcgcttaaattaaagcgtaccatcagctctgcttttggatcatcttcgtggcgtataatttcgataacttcatcaatatttaaaaaggctatcatcaagccttctaaaatatgcaagcgagagagtactttatctaagcgatattgaaggcgacgagtgaccgttgtgcgacggaagtcaagccattcatttaagatttctaataagccttttaccgctggtttatgatcaagcccgatcatattcatatttacacggtagtttttttcaagatctgtggtcgcaaataaatgtgccattaaggcatcagtatcgacgcgatttgagcgagggactagcacaatgcgaattggattttcgtgatcggcttcatctcgaatatcttctagcattggcagtttttttgccgtcatttgttcggctatttgtgcaataactttggatggcgaagattgatgtggaagcgcagaaataataatttcaccgtcttcttgtttccaagttgcacgcatttttattgagccacgaccttgctcataaattttacgaatttctgattttggcgaaataatttccgcttctgttggaaaatctgggccttgaacaatttcaagtacatcatctaatctcgctttaggattatctagcaacattactgccgcatcagcaatttcgttaatattgtgtggtggaatatctgtggccatccccaccgcaatacctgttgtgccgttcaataaaatatgaggtaaacgagcaggtaaatattgtggttcagccaaggttccatcaaagtttggttgataatctactgttccttgtccgagttcactcaacaagatttcagagattttagataggcgagattccgtataacgcatggcagcgaaggattttggatcatctggtgccccccagttaccttgaccatctacaagcggataacgataagagaagggttgtgccattaacaccatagcttcataacaagcgctgtcaccatgtggatggaatttaccaagtacatcaccgacggtacgagcagattttttgtattttgccgtggcatttaagccaagttcagacatcgcatatacaatacgacgttgaacgggttttaaaccatcaccgataaaaggcaacgcacgatccatgatgacatacatagaatagttgagataagccttttcagtgaaggtgcgtagaggcatttgctcaatgccttcatagttgatatttgtcatttttgtttctgttaattgatatattcttaatttattaaaattcggatttgctgagattaatttagtctaaacagataaatcaacctgatcgcctttcgcttgtaaccaatttttacggtcttcggaacgttttttcgctaataacatatccatcagttctaatgtatctgagccttgatcttcccctaaatcataagttaattgaacgagacggcgcgtattaggatccattgttgtttcacgcaattgcgatgggttcatttcacctaaacctttaaagcgttgaacattcggtttgccttttttgtttttcaaccgatctaaaatcgcctctttttcattttcatctaatgcgtagaagacttctttatttaagtcaatgcgataaagtggtggcattgcgacgtaaacgtgaccgtcttgtaccaatttcggaaaatgacgtaagaacagggcgcagagtagggtggcaatatgcagaccatcggagtcagcatccgcgagaatacagactttaccatagcgaagttgtgataaatcattgctgtcaggatcgatccctagagccacggcgatatcgtgaatttcggttgaacctaatacttgatcaggggaaacttcccatgtgtttaagattttcccacgtaacggcaaaatcgcttgatattcgcgatcacgtgcttgttttgctgagccgccagcagagtcgccctccactaaaaataattccgttttttctaaatcctgtgagccacaatcagctaattttcctggtaatgctgggccactaacgagtttttttcgcacgacttttttggcggcgcgtaatcggcgttgtgcagaactaatggcaatttctgctaatttttcagcatcttgtacattttgatttagccataggctgaacgcatcttttaaaacaccgctgacaaacaccgcactttggcgtgatgataagcgttcctttgtttgccctgcgaattgcgcatcctgcattttaagggaaagaatgtaagaacaacgatcccaaatatcatcggcggtaagttttaccccgcgtggtaatagatttctaaattcgcaaaattctcgaatggcatctaataaaccttgacgtagaccattaacatgcgttccgccttgaattgttggaattaagtttacgtagctttcgccaatcagttcaccaccttctggcaaccaaagtaatgcccagctaaccgcttcatttgttcctttaaattcgccaacaaatggtttttccggaagggtttcaaagccatttactgcttcgataaggtaatcggaaagcccatcttcatataaccaaatgtcttgagtattgtttactttatcaatgaatttgatttcaagccctgagcagagtaccgctttcgctcttaataaatggcgtaggcggctaacggaaaattttgcgctgtcaaaatattttggattcggtttgaagtgaacggttgttcccgttgtgcgtctaccacaagtcccgataatttccaattcttctactttactgccgttttcaaaggcaattttatagatttcgccattgcgtttgacttgaatatccacgcgttcagaaagcgcatttaccacagaaatccccacaccgtgtaaacctcccgcaaattcataatttttattggagaatttaccaccagcatgcagtttagtcaggattacttctacgccagaaacgccttccgtaggatgagtatccacaggcataccgcgaccattgtccgttacttcaatggattgatcagggtgtaaaattacttcaatttttgaggcaaaaccggcaagggcttcatctacgctgttatcaataacttcttgtgctaaatgattagggcgagtagtgtcagtgtacattcccgggcgaatttgcactggttcgagatctttaagaacggtaatttcttgagctgaataattggttgtcatggtgaggttattcgttaattttttaaatttgagaaaattctatcaaaaagtgcggtgatattcgaccgcacttttaatcgtataaactaggcgtcttttcatcggggcgcgttttaaaacggcgatgtagccacatatattgtgatatccccttcatgatttccttttctacgatttgattcattcgcgcagcaatcgccgtttcatcttgtaaatccgtaaaatcaacaggcgctgaaatactcacggtatagcctgaaccatctttattgcgtaatggcgcaaatggaatcactttgctgttttgtgaagatttcaataaataataactaccagtggttgtgcaagcatcgggtaccgcaaaaaagggaacaaaaacggcattttttctgccgtaatcgtgatcaggcgcataccaaatggtttcttcgtggcgtaaagctttgatcattccgcgtaaatctttacgatcaagcatatctttattagagcgtaaacgaccttgcgtttgtagccaatcaagcaaaggattatcatttggacgataaacgccaatgccgggatgatgcaaaccaagaatgcgcgcgccaagttctagcgttaagaaatgaacaccaacgagaacaattccatctttttgattttcttttagataatgtaagccttcaacttttgaccattttttgatacgtgaatccgaccaaaaccaagccatgccagtttcgataattgccatgcctacagagcggagattttcttgcaaaatcgcctcacggtcgttttcagacatatcaggaaaacaaagttcaagattacgacgtgcaatggctgctcgacgtttacccacttttaaatgtgaaaacagccaaccgagaccatgaccaatatggcgcaaaataggatagggaagacataaaatacttcgccaaattgccacgcctaaccaaaaaagccagtattttggggctaaaaagtgcggttgaaattgagggagtttttcgtttttcattgttctttccacgtaagttaggggcgtagtttatcgtaaatttgagttgtggtaaaattgccacaattttggttattcaaatagagagattttaaaatggctcaatattcagcagaatttaagcaagcaaaagtacttgtattaggcgacgtgatgcttgatcgttattggttcggcgcaaccaaccgtatttcaccagaagcaccagtgccagtagttcgtgtacaagaaaatgaagaacgcgcgggtggtgcagcaaatgtggcgatgaatattgcttcactcaatgtatccgttcagttaatgggattgattggacaagatgaaactggttctgcactttccctcttattagaaaaacaaaaaattgattgtaattttgttgcattagaaacccatccaactattactaaattacgtattttatctcgtcaccaacagttactccgccttgattttgaagaagatttcaataatgtagattgcaaggatttattagcgaagttagaaagtgcggtgaaaaattacggtgctttgattctttctgattacggcaaaggcacgcttaaagatgttcagaaaatgattcaaattgcacgcaaagcgaatgtgcctgtgttgatcgatccaaagggaactgattttgaacgctatcgtggtgcgacattattgacacccaatatgtctgaatttgaagccgttgtgggtaaatgtaatacagaagaagaaattattaagaagggtttaaaattaatttctgatattgaattaaccgcacttttggtaacgcgttctgaaaaaggcatgacattattacgcccaaatcaagagccttatcatttgccaaccgttgcaaaagaagtgtttgatgtgacgggagccggtgacactgtcattagcgtattagcaaccgcattagcagatggacgttcttttgaggaatcttgttacctagccaatgtagccgctggaattgtggtgggtaaattggggacttcaacggtttcgaccgtggaacttgaaaatgcgattcatgctcgtcctgaaactggatttggcattatgagtgaagcagaattaaaagatgctgtcgcacaagctaaagcgcgcggtgaaaaaattgtgatgactaatggctgttttgatattttgcatccagggcatatttcttatttagaaaatgcacgcaaattgggcgatcgtctaattgttgcggtaaacagcgacgattctgttaaacgcttaaaaggcgaaagtcgtccaattaataatcttgaaaaccgtatggcggtattggctggtttggcatccgtggactggttggtgcctttcactgaagatacaccacaacgtttaatcggcgaaattctaccagatcttttagtcaaaggtggcgattacaaacccgaagagattgcaggcagtaaagaagtttgggcaaacggtggcgatgttaaagtgctaaactttgaaaatggttgttcaacaacaaatgtgattgaaaaaattaaattattgaaagattaagtgaaaggttaggggctacttgtttatcataaaaaacaacgaaatataatgggaagtggaatataaccagatggttatccacagtttcgtggattaaaattagtttagtgttttttaagtaagcttggttgcttgtgttaaaggctctatctgaaatacaatatctctcgttttttattattttaattttatatgtcattaacttatctcgatttattttctggtgctggcggtctttctctaggatttgattatgctggatttcgccagttactttccattgagttagagccagtatattgtgaaacctaccgcgttaattttccgcatcatcgatcttgcaacaggatctaactcagttatctaatgaacaggcaaatctttaccgtagcgatattcccaaccgagggattgcaggcgttgaagagtgagttgttcgatatcgttttcgttgagcatgatgagttccttagtgtgtggtttaaatctcccctaacccctctttacaaaagaggggaatggtcttgagcgtagttttagtttaggtgttttcatgaataatttttctgttaattcgaccgcttgcagctaaacattccaaatagtccccctctttagcaaagaggggttaggggaaatttggcataggtgaaatgaaccttgtaagaaattagagcgtgtccatcaaccgttcatattctatttgctcaaactccaataccatttctctataggtatcaggatcttgagcaaataatgcttgtgaatatgaaattttatatattgtttccatttcatacgcctcatcaattaattcgttgattctttgattatcttcatattgtatcctttcacttctacggtaatcatttgtagcaatgtaaaagtgtagaataaatcctaaaattgcattggttgaatgaagtacaaataaagcaagatcactacttatttgtttgtgttctatatcttgaccgtgagaagcataactaccacattcgtttctaatttctgcaatataatgcaaaatcgaaccacaaaattatccgcactttcgggcggttggttacgcaaagcggcactagcacgtgcattggtatgcgatcctgatgtgttattacttgatgaaccaaccacttggatgtggaagttattgaatggctggaaaatttcttactggatttccaaggtagcattgtatttatttcccatgaccgttcttttattcgcaaaatggcaacacgcattgtggatttagatcgcggtcaattgcagtcttatctaggcaattacgatttatatttaaccacgaaagaagaaaatctacgcgttgaagccttgcaaaatgaattatttgataaacgtcttgcacaggaagaagtgtggattcgccaaggtatcaaggctcgccgtacaagaaatgaagggcgagtgcgagcattaaaagcgatgcgtgaggaacgtcagttaaagccttatcggggggagaacgaaatcgtttattactcgcaaaattgttgctcaaaccaaataatttattgattcttgacgaaccgaccaatgaccttgatgtagaaacattggagcttttagaagaaattttgactgattatcaaggcacattgttaattgtgagccacgaccgtcaatttatcgataatactgccacagaatgttatttattcgaaggtgaagggcatttgaataagtatgtgggaggattctttgatgcgaaacagcaacaagccaatttctgggcaagtaaagcagtggaagagcaggctaaagcgaagaaaactgaaccgctaaaagaagaaagtgcggtgaaaaatgaccgcacttctaagccgaaatccgtgaaactttcttataaagaacaacgtgagttagaacagctgccacaactattggaagagttggaaactaaaatcaccgtacttcaagctgaaatagccgatccagcatttttccaacaggctcacgatattaccgacgctaaattaaaagcattggcggatactgaagccgaattagaaacagcatttttacgctgggaagaattagaagaaaagaaaaatttggctgacggtaaagcttaaaaaaataacgcccaaaagggcgtttttttatgtattttcaagatgatcttttttcaaaatattttcttcatcaagtattgataaacgagcgatagcgtttcgataagaaatttcaagggtttctctgctggttgccattacgccttgatccactaaaaatccatcatttacatcatatacccagccgtgtaatgagagtttttgtccgcgttcccaagcactttttacaattgatgtgcgccctagattgtaaacctgttccgctacgttaattttagttagcatatcggcacgtttttctggagaaagtttaccgagaagatgaccgtgtttaaaccaaatatcacgaatatgaagaagccagttgttgataagccctaaatctttatctgccatagcagcgtgaattcccccgcagttggtgtgaccacagataataatatgttcaattttaagcacatcgacggcatattgcacaacagaaaggcaattaaaatctgtgtgaattacttggttagcaacattacgatgtacaaaaagctcacctggttcaagattcgtcaatttctcagcgggtacacggctatcagagcaaccaatccaaaggtaatgtggcgtttgatgatccgcaagttctttgaagtaagtagaattttcttctttcattctttgtgcccaactgtaattgttggcaaagagttgtttaattttatccattttactttccttaaaattctgaaaaaattaaccgcactttggcgtaagtgcggtcaatattaaagttaaattgaattagaaattcgcatttcttggcgcgcgtgggaatggaattacatcacgaatattttgaacgccagttacatagacgattaaacgttcaaaaccaagaccaaaaccagaatgtggaacactgccgtatttacgaagatcgcgataccaccaataatcatctggatttaatcccatttcttccatgcgtttatcaagcacctctaaacgttcttcacgttgtgaaccaccgatgatttcaccaattcctggagctaacacgtccattgccgccacagtttttccatcatcatttaaacgcatatagaatgctttaatgtcttttggatagtttttcaccacaactggtgatttgaaatattcttccgctaagaaacgttcgtgttcagaagaaagatcaatgccccaagaaacagggaattcaaatttcttaccagattttaataacacatcaatggcatcggtatagtcaatttgcgcaaaatctgagtttacaaagttttctaaacgagtaataacatctttatctacatgtttttcaaagaattgtaagtcgtctttacgctctgctaatactgcacgaaatacgtatttcaacatatcttctgcaagttttgcgttatccgctaaggttgcaaatgcaacttcaggttcaaccatccagaattcagctaagtgacgggtagtattcgagttttctgcacggaatgttgggccaaaagtataaattttgcttaatgcacaagcataggtttcgccgtttaactgacctgaaaccgttaaaaatgattctttaccgaagaaatcttggctgaaatccacttttccattttcactacgtggaagattttctaaatcaagtgtagaaacacggaacatttcacccgcaccttcagtgtctgatgcagtaattaatggggttgccacccagtagaaaccttgctcatggaagaaacggtgaattgcttgagacaagcaatgacgaacacgcgcgaccgcgccaataatattggtacgagggcgtaagtgagctacttcgcgtaaatattcgatagagtggcgttttgctgccattgggtaagtatctggatcttcaacaaaccctgtcacttccactttttctgcttgtaattcaaccgcttgtccttcagaaggtgattcaacgactttaccagttacaatcacagaacagcctgttgttaaacgtaaaatttcgctttcgtaatttttaatatcgttattaataattgcttgaattggatcaaagcaagaaccgtcataaaccgctaagaaagataagcctgctttagaatcgcgacgggtacgaacccaaccacgcacagtgacggtttcaccaatcgccactttcccttgtaatacatcaacaattgatgccactttagacatattaaacctctgtaactgaatgtaattcacataaaattgccgacagtttaccttaataaaggaaattttccataaaaatatagtgttggtgcgggctatgaacaataaaatcgccttaaaaatgagccctaaataaaatagggtaaagcctcattaatattgaatatacgcgattttatgttaaaatctcgggccaaaatcattatggctaataataggaaaaaatatgaaagttttagaaggctcagttgcagcacctaatgcaaaagttgcagtagcaattgctcgttttaacagttttattaatgaaagtttattagaaggcgcaattgatgcattaaaacgtatcggccaagtgaaagatgaaaatatcactatcgtgcgtaccccaggcgcgtatgagttgccattagttgctcgtcgtttagctgaaagtaaaaaatttgatgcgattgtggcattaggtacagttatccgtggtggtacagcacattttgaatatgtagcaggggaagcaagcagcggtttaggaaaagttgcaatggatgctgaaatccctgtcgcttttggtgtattaactacagaaaatattgaacaggcgattgaacgtgctggtactaaagcaggaaataaaggtgcagaagcagccttaaccgcacttgaaatggttaatcttattcaacaaattgatgcggcataaatcatgacagaacaaaaacaagtgaaaaagccttctgctcgtcgtcgtgcgcgtgagtgtactgttcaagccttgtattcttgggcagtatccggcaatactgcagaacaagtggaattagcctttgtgttagatcaagatatggatggggtagataaaccttacttccgtaaattatttcgtcaaacagtagaaaatattgaaaccgttgatttttcaatttcgccttatattgaccgcgcttttgatgagcttgatcctattgaaacggcaattttacgtttggccgtttatgaattgtgcttcgagttagatgtgccatataaagtggttatcaatgaagcgattgaagtggcaaaagtattcggtgcagatgaaagccataaatatatcaatggcgtacttgataaaatcgcaccagcattagggcgtaaataatccttttaaactgagaatggcgcgcgtttttaatgcgtgccttttcttttataagataggtgaaaaatggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaggcactttaggcgatagcgcggcaggtttaacacaaattttattgggcaaaagtgcggttgattctgatgatgtttttttgcaacaacgacatcttagacccacacctagaattgaacttgggcgggcgttaattgatattgctcatgctgccattgatctttccgatgggctaatatctgatttagggcatattcttgaacgaagtcaatgtagtgctgaagttgaactgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataattttttcaagcggtttcgatcattttaaggaatcaaaatgacagaaaataatcctcttaaaaaaatctctcttttaaatcctattcatttgcttgccgttggttttggctcgggtttaatttatccagcacccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtgatgctaaatttaatcattgtgcatttatttggattaatgacgccagggcctgatttcttttatgtaagtcgaatggcggcaagtaactctcgtcgtaatacagtttgtggcattttaggcataacgcttggtatcgctttttggggaatgctttctatgttgggattggcggtgttgttcgttaccattccagcattacatggcgttattatgttgctaggcggtagttacttagcatatctcggttttttaatggctcgcagcaaaaaatacgctcaatttgaaccgcactctgatactgaatttaatcagcaaaccacaatcaaaaaagaaattttgaaagggcttttagtgaatttatccaatgcaaaagtcgtggtgtattttagtagcgtgatgtcgcttgtcttagtaaatatcactgaaatgtggcaaattatcttggcttttatggtgattgtggtagaaacattttgttatttttatgtgatttcattgattttttcacgtaatattgccaagcgtttatacagtcaatacagccgttatattgataatatggcaggtattgtatttttattttttggttgtgcgcttgtttataacggcatcaacgaaataattcattaatagaaaaggaagtaacatgacattaaaaattgcaatcgctggtgctggcggaagaatggggcgtcaattaattcaagcggttcattctgcggaaggcgtagaactaggtgcggcttttgaacgcaaaggatcatctttagttgggacggatgcgggagaattggcaggaattggtcatcttggcgttgcagtttcagacgatcttgaaagccaaaaagataaattcgatttattaatcgattttacccgaccagaaggctcccttgaacatattgcattttgcgtagcgaataataaaaaaatggtgatcggtacaacgggttttgatcaaaatggtaaagcagcgattaaagcagcttcagataaaattgctattgtgtttgcatcaaatttcagtgttggcgtgaatttagtcttcaagcttttagaaaaagcagcaaaagtgatgggggattattgcgatattgaagtgatcgaagctcatcaccgtcataaagttgatgcgccatctggcactgcactttctatgggcgaacatatcgcaaaaaccttaggtcgcgatttaaaaacgcacggagtcttctgccgtgaaggaattacaggcgaacgtaaacgggatgaaattggtttttcaactattcgcgcttcggatgtggtgggggaacacacggtttggttcgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataaatcaatttcaaggtcactttctacgtgacagcaacataataaaatctcatcaggttgaataaaggcaagaggcatttctttataagacaccttgccttttttgatcttaacgcgacaagaaccacaatagccactacggcattgatattcgtgatgaatattatttttctcgagatgatcaagtaaacttgtttcattattgaattctaatgtggtgttatggcggataaggtggattttcataataacgatatgttgtaatttgtcgtactattatataaggaaaagatgaaattattgataaaaacttcacttagtcagtggatttgcttgaattttgccaaaattcctatttttaaaatgctaggttttataaccgcactttttattacggcttgtagttctattagcaaagaaccagtgaagactgtggatatttatattaaaccttattattctgctgaaaatggaaaagcagaaaatgtatttgtacataaagaaattgatcctatgttacgtgaaaatacgctaaaaggttataaaagtacggtaaaatttttagaagaaaatccagctcgcatttcaccaatgacaatgtttaccttagccgctcgggcttacgattttggcttaagagatgaagcggttacttggttttatcgtggtcaaaatcgtttgatcaccgcactttatgtgttggatttaccaaaacaaacggtgcaggataatacagggttcagccatgttgtagggcagtttgttaatgcttatgcgttttgtgattttgataaacaaagtcgtgctgccgaaaatgcggtgaaatggacaattgcgcatccttatgaagtggttttcttaccagcattacccgcaaaatttgcagatcgtcaaaaagcgttaaaagaatcggaagaaaaattagttcaacgtttacaggaacaagcccgtttttttgctaatccaaaaaataaagaaaaatggcaaaaaaagcggtcagaaaattttgtgaatgaacgattttgttggtaacaagaaaaaatggaatagcgaatacgttattccatttttatttttgataagccaatgatttttcgcattattcttttactttttaaggacttggtattatcattactcggttttttattttatagagaaaagagaagcaggggaaactatgcaacatctgaacgagcttgttgagaaagcgaaattagcgattgaatccattcaggataaaagtttaacggctttggatgaaatccgtgtcgaatattttggtaagaaagggtattttacgcaattaatgcaagaattgcgtaacgtgtcagcagaagaacgtcctgcgatgggcgcaaaaattaacgaagcaaaacaagctgcgttagaatttttaaatgcaaaaaaaacggagtgggaacaggctgaacttaacgcaaaattagaaaaagaacgtgtagatgtcagtttaccaggtcgcaaagttgaaactggtggcttacacccagttaccatgacgattaatcgtgtaacaaaatttttctcagaacttggcttttcagttgaaaatggccctgaaattgaaagtgattattacaactttgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcaccgaattgaaaggtttattgcacgatttcttacgcgctttctttgaagaagatttacaagtgcgtttccgtccatcttatttcccattcacagagccttcagcggaagtggatgtgatgggtaaaaatggtaaatggttagaagtgttgggctgcggtatggtgcatccaaatgtgttgcgtaacgttggtattgatccgaatgaatattctggttttgccgtgggaatgggtgttgagcgtttaacaatgttacgttataacgtaacagatttacgttcgttctttgaaaacgacttacgtttcttaaaacaatttaagtaatttctcggatttgaattaaaaggataacaacaaatgaaatttagtgaacagtgggtaagagaatgggtgaaccctgcggtgtccaccgagcaattatgcgagcaaattaccatgcttggcttagaagtagatggcgtggaaagcgttgcgggtacatttaatggtgtcgttgttggtgaagtagtggaatgtgcacaacatccagatgcagataaattacgtgtaactaaagtgaacgtaggcggtgatcgtttattggatatcgtgtgtggcgcagcaaattgtcgtcaaggcttaaaagtggcttgtgcaacagaaggtgcggtattacctggcgatttcaaaattaagaaaacgaaattacgtggtcagccatcagaagggatgctttgttcattttctgaattaggtattgatgttgaagcggatggtattattgaattgccacttgatgcaccaattggtactgatttacgtgaatatttagctttagatgataatgccatcgaaattagcttaacgccaaaccgtgcagattgtttgagcatcgcaggtattgcgcgtgaaattggtgtggtaaataaacaactcgtaaatcaaccgcactttgaagcagtgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgctgtggtattcgttctatcgatcctattgtcgatattactaactatattttgcttgagttcggtcagccaatgcacgcgtttgatgcagctaaagttacacaacctgttcaagttcgtttcgcgaaagagggggaagaattagtattattagatggctcaaccgcaaaacttcaatcaaatacgttattaattgctgaccaaaatgggcctttagcaatggcagggatctttggtggtgcaaccagtggcgtgaatagtgaaacgaaagatgtgattttagaatccgcatttttcgctccattagcgattgcaggccgtgcaagacaatatggtttacatactgatgcatcgcaccgttttgaacgtggtgtggattttgaattagcccgtaaagcaatggaacgagcaaccacattattacttgaaatctgtggtggtgaagcgggtgagatttgtgaagcaagcagtgaaactcatcttcctaaagtcaatacagttcaacttcgccgtagtaaattagatgcacttttaggtcatcatattgaaacaggaagcgtaacggaaattttccaccgtcttggtttcgatgttacttatgcaaatgatatttggacggtaacttctgcaagctggcgttttgatattgaaatcgaagaagatttaattgaagaagtggcgcgtatttatggttataacagcattccaaacaatgcgccattagcgcatctccgcatgcgtgagcacaaagaatctgatttagatttagctcgaattaagaccgcacttgtggatgcagattatcaagaagctattacttatagctttgtggatccaaaaattcaaagtttattacatccacataaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtaatagagttcgttttgttgcaaaacaatttgatgcattacaccctggccaatctgctgctattgaattagatggtcaagaaattggttttattggtgcaattcatccatctattagtcaaaaacttggcttaaatggcaaaacgtttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaatatggctacgataactaaacttgatattattgaatatttaagcgataaatatcacttatctaaacaagatacgaaaaatgtggtggagaactttttggaagagatccgcttatcgctagaatctggtcaagatgtgaaattatcaggatttggtaattttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatagtaagcaacaaaaagtgcggtgaatttctaccgcactttttatatgaaaaggtatgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacccttattggtcgaaagccttctggcaagtcagacggatttaaaaagtataatgctggaattttccagcattttttataatgatttttttcaaattagggagataaaaatgccctcaaacttaaccgcacttcaaattcaacttgaaattttacgccttattccaaaaactcgttttattaccgcagaagaaatcttacaaaaacttgctgatattggtgttcaacgtgatattcgttcaatccaacgcctgctagaaagtttgtctcaacagtttgaaattgagcgagatatgcgtgataaaccttatggatatcgatggaaatcaaatgctaaaggcttggatttaccgattttaaatgaacagcaatcacttgtgcttatgcttgctaaacaatatctcaatggcattttgccttctagcattatgaactcaatggaggcgttctttcaacaggccgaatataatttggtttatgacagccataaaaaatcaggggcagaatggcttaataaagttgctattgcaccaactagtcagccgttattacctgccaaaatcaatccagaaattttttctcaaattagtaccgcactttatcaaaatcgatttttacaggtgcattatcggagtattcacggtaaagaacataaggcacaggtcaagccattggctttggttcaacaaggaccaagtagctatttagtcgcacaatatgagaatggcgatattttacaccttgctttgcatcgcttgcttaaggtaacagtgagtacaatgatatttgaacgccctgattttaatttgaaatcttatgtagaaagccaaaagtttggttttacctatggtcgaaaaattcgattaactttccgcattaataaagatattggtggatttttaacagaaacaccattatcaatggatcaaacagtaaaagattgtggcactgaatatgaaatttccgctaccgtgattaagagcgctatgctggaatggtggatagcccattttggtgaagattaccaagaaattgaccgcacttatttagacgaaaatgcctaacgacataaattgtcgcttcatcttttatcattaagccatcaacagagagggcattaaaatgaagaaaattgtttatattgatatggataatgtgatggtagattttccatcaggtattgcaaaactagatgataaaaccaagcgagaatatgaaggtcgatatgatgaagtcgagggcatttttagcttaatggaacctatgccgaatgcgatttctgcggtgcataaattgatgaaaaaatatcatatttatgtgctttctactgcgccttggcataatccttctgcttggagtgataaagtaaaatggattcaacattatttcggtgaagaaaaaggttcagccttatataaacgattgattttatcccatcataaaaatctcaaccaaggtgattatttaattgatgatcgcactaaaaatggtgctggcaaatttcaaggcgagcatgttcattttggtacagaacagtttgctaataaaaggagcctgaaaaatgacagagaaaaataaaccaatttgcgtggtattaacgggagctggcattagtgccgaaagtggaattccaacttttagatcggaagatggtttgtgggcagggcataaagtagaagaagtttgtacgcccgaagccttgcaaaagaaccgtgcgaaagtgcttgatttctataaccaacgccgtaaaaatgcggcagcagctaagccaaacgctgcgcatctcgccttagttgaactagaaaaagcctatgatgtgagaatcatcacgcaaaatgtggatgatttacatgaacgtgccggcagctcgaaggtgttgcatttacacggtgaattaaataaagctcgcagtagctttgatgaaagttatattgtggattgttttggtgatcagaaattagaagataaagatccaaatggacacccaatgcgcccttacatcgtcttttttggtgaaatggtgccgatgctagaacgagcggttgatattgtggaacaagcagatgttgtgttagtgattggcacttctttacaagtgtatccagccaatggcttagtcaatgaagccccaagaaaagcgccaatttatctgattgatcctaacccaaatacaggatttgttcgtaagcaagttattgcaatcaaagaaaaagcaggcgagggtgtgccaaaagtggtggcagagttattagagaacaccaaaaactcatagaaaaatgaccgcactttttaaacaaatagcgacttcggtcgctatttatcattttttctcttgcttaagcatatgcataataagcctaataagcgtttctttttgtttcggatcagattcagcaactaataaagtgagcgcggcaagcccagtatcattgataactgggtatccattatgatcaaacaaacgcccatttctatgtaagaaatctacaaataaaaatgcgccgctacgtttattaccatctgaaaaaggatgattcttgacgacaaaataaagtaaatgcgccgcttttgcttcaatgcttggataagcaggttcaccaaatacactttgatctaaattacctagaatcgcagataagccgttatctcgttcacgtccaaagagatcacttgcttcaccttttgtcatcagctgtgattttaactctgctagtgcagaaaaagcctcagcataagtcggtaatgtaccgccttgctgtgtttgtggttcggcaagtaaaccttcatcatattgttgtagccataaaaacgtatgcgtataacggctgacaatatccactaatccgcgaccgctttctagcgttaattccgatgaatttgccgttttttgaataagcgcaagtgcttgttctaattcgtgagcattttgctgtaaacgtttttggttaatggtatagccttgagtcagatattcttttaaacgtgcagttgcccaacggcggaaactaatgccttgtttagattttactctatagccaacagagataatcatatctaaatcataatgctcaatttcacgattgacttggcgtttaccttcttggcgaactatccggaatttccggatagttgattctttctcaagttcttcgtcatcaaatatattggtaatgtgctcattgatggtgcgaatatctttaccaaataacatagccatctgcgcttgggaaagccaaacggtgtcattttcaaatctcacttccacttgcgttgtgccatcttgagtttggtaaatttcaatcgggttttggttattcatattattttccttaataactaacatgtatatataaccagataaatatgcatattgcaatacagagcatcttatttgcaaaaaatcttctaaaaataaccgctttcaatattcacaaacgacacaagttgtcgcttcctttcatataatttctccataaagagaaattctttacttcttacatatttataaagcctttaattaagaaaaaggagcaaataatggcaatgaaagtaattatggcaagagatccactttttgaggatgtaaaaaaatatgtgcaacaacaaaaatttgcatcttgctcaatgattcaacgcagatttatgttgggttttaatcgagctgggcaaattttagaacagttggaacaagcgggtattatttcatcaatgaaaaatgggcagagaaaagtattatgaaaaatgatttgaattatgcagtggaacttatccgcaaagcggatggcattttaattacagctggtgcgggtatgagcgtggattctgggcttcccgatttccgcagcgttggcggattttggaatgcttatcctatgtttaaagaacataatatatcttttgaagagatcgcaacgccactagcttataagcataatcaggaactagcctattggttttatgggcatcgattagttcaataccgaaatactcttcctcacgaagggtatcagattttaaaatgctgggcgggagataaacctcatggatattttgtttttaccagtaatgttgatgggcattttcaaaaggctggttttaatgatagccatgtttatgaagtacatggtactttggagcgtcttcaatgtgtcaataattgtcgaggattaagttggtctgcatcaagttttcaacctgtcgtggataatgaaaacttatgtttaaccagtgaaaaaccacattgtccttattgtgggggctttgctcgtcaaaatgtactaatgtttaatgattggagttatgcaagtcaatatcaggattttaaaaaagtgcggttagaatcgtggttaaaagaagtgcaaaatctcgtcgttatcgaactgggagcaggaaaagccattccaactgtgcgtcgattttctgaacgtacggcgaaagcaaaaaaagggggggttatccgtattaacccacaagatgcaggcgtgccgaaaatgcactttttaagtctagaaatgaaagcgttagatgcactaaaagcgattgatcgccttctaaatccttctcaacaagcggttgaataatggaaaatttttgcgaaattaccttttgccaacaaattggcagcaacaagcgacgcaaccaagatgccctttttaatggcgaggcggtgtttcaatataaactcaaaacggctgaaaaacgccttgaaaaccgaccgcactttattgtgggcgtggcagatggtatttctaatagcaaccgacctgaaaaagcgagcaaattggctatgcaattattaagccaaatggaaagtataaaccgtcaaacgatctacgatttacaatccagtttatcagcagaattagctgaggattattttggttcggcgaccacatttgtggctgccgaaattgatcaaataacccgtaaagcgaaaattctcagcgtaggcgatagtcgtgcttatttaattgatgcccaaggaaaatggcaacaaatcacccaagatcattctattctttctgaattattgactgatttccccgataaaaaagaagaagattttgccaagatttatggcggcgtttcttcttgtttagtcgccgattattccgaatttcaagataaaattttttatcaagaaattgaaattcagcaaggggaaagtttattactttgttctgacggcttgaccgacgggctttcagatgaaatgcgcgaaaaaatttggcagaaatatcccgatgataaatatcgccttacggtttgccgcaagatgattgagaagcaatcgttttcggatgatttgtcggtagtttgttgtcattctattattgagtaaaaaatatgtttaaattgttttttttttgctcaattatctataattcggtgaattttaactagaaataaggaaaaactatgtttgaaaaaattgaacctactaatattcgttttattaaattaggcataaaaggatgttgggaaaaagattgtattgataaaaatagtacagcaagtacaaaaaatacgattcgtcttggctatgaatctacatcagagattcacaaagaatgtttgaataatcaatgggatagttgtattgaatattgtaaaacttattggagtgaccatacaggaactgtttcaaatcacttgagacaaattcaagatttttatcaacttggggaagatacactttggatcaccttctttggacgtaaattatattgggctttttgcagtaaagaggttgttgaggaaagcgatggttctagaacaagaaaagttattagtaacaatgggaattggtcttgcgttgatgctaacggtaaagagcttttagtcgataatcttgatggtagagtaacaaaggtccaagcctatagagggacgatttgtggtgttgagatggaggactatttaatacgtcgtataaatggtgaagttattgaggaaattacagaagcgaaagaggcgtatgaaacattaattaaatcagttgaaaaattaattaaaggtttatggtggagtgactttgaacttttaacggatcttgttttttctaaattaggatggcaacgatactctgttttaggtaaaacggagaaaggaatagatcttgatttgtattcgtcttcaacgcagaagagagtatttgtgcaaattaagtcagatacggatattaaacaattagacgaatatgtttcgaactttgaaagtgaatataaaaactatggttattcagaaatgtattacgtatatcattctggtttagaaaacatagatgaaaaacaatatcaagctaaaggaattaagcttgtaaatggccgaaaaatggcagagcttgtaattagtgctggtttagttgaatggttgattaacaaacgttcttaaaactatccttaacgacaccttttgtcgcactactcactaaaatactccttaccaacccagtaaggagtatttttttatgtctgaatataaattaaacccaccgacagtgtcttcttatactgaaaatatgatgcttaaagttttatttgagcataaaggtttttccgaagtgtttcgggagactagctggcgaagtgatgaaattgccagtgcatttgggctgcctgaagaattgagagaatgataaaaatttacgcacggttgctcgtcggcttttaaaagagcggtataaaaaactccaaaaatccaccgcacttttacctgagttatggaaacaggcgtatgaaaatttggcaacgttggcagaatttttgcaactgaatcccgttgaacaggaacttctccgctttgccatgcatttacgtagtgaaggagctatgcgagatttgtttggctacttgccgaaatcggatttacaaagaacggctgcgatcatggcggatttacttaaacagccgaaaaatcagattctatctgccttaaagaaaggcagtaaactcgatgcttatggcctgattgatcgcgattatcgccccgatagtgtgcatgattatttagattggggcgaaaccttagattttgatgaatttgtgacacaaccattaaacgaaaacgtcctattaaaatcttgtacggaagtcgctcaagtgccaagtctgcaactggatgattttgaccatattgccggcatgaaagagatgatgttgacttatttgcaacaagcactaaaacatcatcgaaaaggcgtgaatcttttaatttatggcgtgcctggcactggtaaaacagaattcgccgggttgcttgcacaggcgttggggatttcggcgtataacattacttacatggattctgacggagatgttgtggaggcagagcaacgcctgaactacagtcgtcttgctcaaacgctattgaacggcaagcaggcgcttttaatttttgatgaaattgaagatgtgtttaacggctcgtttatggagcgttctgttgcacaaaaaaataaagcgtggacaaatcagttattggaaaacaataacgtgccgatgatttggttatctaactctgtttcgggcatagatcctgcttttttacgccgctttgattttattttagaaatgccagatttgccgttgaaaaataagtcagcactgattacgcaactgactgagggaaaattaagtccggcctatgtgcagcattttgctaaagtgcggtcattaacgccggcgattttaagccgcacaattcgggtggcaaaggaactcaatacatcaaattttgctgagactttgctcatgatgtttaatcaaacgttaaaatcgcaaaataaaccgaaaattgaaccgcttgttttaggcaaagccgactacaacttggattatgtggcttgtaacgacaatattcatcgtattagtgaagggttaaaacggtcgaaaaaagggcgaatttgttgctatggcccgccgggaacaggaaaaactgcttgggcagcgtggcttgcggaacagttggacatgccgctattgctaagacaaggctcagatttacttaatccttatgtgggcgggacagaacaaaatattgctcaagcctttgaacaagcgaaagccgataatgcaatattggtgctagatgaagtagatacgttcttattttctagagaaggcgcaaatcgaagctgggagcgttcgcaagtgaatgaaatgctaacacaaattgaacgctttgagggcctgatggtggtatcaacaaatttaattgaggttcttgatcacgcagctttacgccgttttgatttaaaattgaagtttgattatttaacgctcaaacaacgcttagattttgctaaacaacaagcagaaattttaggattgccgttgttatcggaagaggatttaagtcagattgaatcgcttaatctgctgacaccaggggattttgctgcagtggctcgtcgtcaccaattttccccttttcacaaggtgcaagattggctgatggcactacaaggggaatgtgaagtgaaaccagcgttttctgcaacgacaaggcggatagggttctaaacagccatacaacattccgatgattatcaaagatccaaactctgatcgtgtaaatcaagaagatgataaccttgtttatcttcacgacttaacttcaacagtctttgatttagccaatcaaaaagtgccagaaagttttgaagggcagagcattcttccgattatgcgccaacaccaagataaccaacgaaaaggtgtacttggtcagcttgcggggcattttgtgtattttgaacagcgtatgtggcgtcgtaaagattacaaactcgtatttaatgcgactgatgtttgcgaactttacaacatccgtaacgatccagaagaaatgcacaatttgttttatgatcctcaatataacagaatcaaaaaagagatgttggaagaaattcgtgcagagatgaaacgtctgaatgacccactggaaaattgggtttatcgaattattgacgaaatttaatcaaagtcgtagattaagggcgtatctgatacgccctttgttatctctgcaccttatttatcttttaaaataggaataaacatgaaaacaacattactaaaaacactgacaccagaacttcatcttgttcaacataatgatattcccattctttatctaaaaccacgctgttggaacagcaaaaatttccctgcaaggggcacagcttatcagttggaaaccgcaaaatgcgaagcaagatgtattatggctaagtgaagtagagccattcaaaaatggcaatgctattcgtggtggtgtaccgatttgctatccttggtttggtggcgtaaaacaacatgcacacggcacagctcgtgttcgtttatggcagttaagccattatgatatttcagcccataaagtgcggttagaatttgagttgttttctgatttaaatattatcgaagcgaaaattgctatggtatttacagacaaatgtcatttaacttttacccattatggcgaagaatcagcccaagcagcattacatacctattttaatattggggatattaatcaagtggaagtacaaggtttacctgaaacttgttttaatagcttaaaccaacaacaagaaaatgttccgtcaccgcgtcacatttctgaaaatgttgattgcgtttattccgcagaaaacatgcagaatcaaatcctagataaaagtttcaatcgtacaattgcactgcatcatcataatgcaagtcaatttgtcctttggaatccttggcacaaaaagacgagtggaatgagtgaaactggctatcaaacgatgttgtgcttagaaactgcacgcattcatcacttacttgaatttggcgaaagtttaagcgtggaaatttcgcttaaaggctaaattttgttgcataagtggtgtgaatactatagaattcgtgggattttgctcgtttctcgcgggcaacaaatttgaaatcttttatttttagcgaaaaagatttttactattaaccattagaaggaatacgattattaaaaccgtaaaaaaagcaccggcagtaaatcgcccaaaccgtatcaatgaagagattcgtgtaaaagaagttcgtttaattgaccaaaatggtgaacaggcagggattgtttctattcaacaagccctagaaatggcagaacaagcagagcttgatcttgttgaaattagcccaaatgcagagccgccggtttgtcgcattatgaactacggtaaattcctttacgaaaaaagtaaaaccgctaaagaacaaaagaaaaaacaaaaagttgtgcaagttaaggaaattaaattccgccctggcacagacgaaggtgactatcaagttaaattacgcagcttaatccgtttcttagaagacggtgacaaagcgaaaattaccgtgcgtttccgcggtcgtgaaatggctcatcaagacatcggtttagatgtattagagcgcgtaaaaaatgatttagctgaaatttcagtggttgaatctgcaccaggtaaattagaaggccgtcaggctgtaatggtgttagcaccgaagaaaaaataagaattttgctgagattcttcagcaaatctttttgtttaagtttgacttaaatgaaaagacaactgcatgttaggcacactacgcagcctaactgcttttgaaaaggcaatttaatttgccttatgatggaaatgatcagtgcttccaagtaactttataagttcgcctgattatgttgctttaaacgaaaaatgcggagttattttaacaatgcctaaaatcaaaacagtacgcggcgcagcgaagcgcttcaaaaaaactgcttctggtggtttcaagcgtaaacaatctcacttacgtcatattttgactaaaaaaacaactaaacgtaaacgtcatttacgtcataaatcaatggttgcgaaagcagaccaagttttagtagtagcttgcttaccatacgcataagccgttatttaagcaaaacgtacgattagttcattttagaaaaatattacataggagattaaataatggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcatatcgtgaccgtcgtcaacgtaaacgtcaattccgtcaattatggattgcacgtatcaacgctgcagcgcgtcaaaacggtttatcttacagcaaattcatcaacggcttgaaaaaagcatctgttgaaatcgaccgtaagattcttgctgatatcgctgtattcgacaaagtagcgtttgctgcattagttgaaaaagcaaaatctgcactttaattttttaaagtttagataaagaagaattaggacgctgaaaagcgtcctttttttgcatttgtgacttcaaattttgtaaaatgatgccattagttctcatctgttaaaatctatggccgaaacaatcccactgaatcccatcacgctacctttaaatcaaattagcttaatcgaagcatctgctggtacgggaaaaacctacactattggttctttatatctccgacttttattaaaggcgggagaaaataatttttcacgtccattaaatgtggaagaaattctggtggtaacctttacggaaatggcaacagaagaactcaagaaaaaaattcgtgagcgtataacagatgcgattaataaactcactgcctttgctaaaacccaagataaatccgcatttaaaaatgatgaatttcttaccgcactttgtgataatttagatatttttgaggcaattcatcgcttaaagttagctgaacaaaatatggatctggcggcgatttataccattcacggtttttgtcgccgtatgttgatgcaatatgctttccattctggcattcatttcaatttagaattaataaaagatcaatctgatttattagttcgttttgctaatgaattttggcgagagcatttttatccgttggattttgaatctgcgaattttatcgcgacagaattagtatcaccagcaaaggtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaattttagcgattattaccaatgaactggagaaagattatccaaaagatcagttgaaatcgttaaatcgtaaaaagtaccaagtaaagcgtttaggggattggattaataaaatcaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagagcttgaaaagcgcgttaatgccttaatgacaccagatttactaagcaaactcactctttatcattatcgacaaggcttacaacaaaaacttttagactataaactaaatcatcaagaaaaatcctttgatgatttattgcgtttgctttgtgaagccctgcaagatgcgcaaggggatgaattagcggaaatgattcgtttccaatatccttttgcgatgattgatgaatttcaggatacggattcacaacaatacgctattttttcaaaaatttatcgtgataatcccgaaaaaaatactggttttattatgattggtgatccgaagcaggcgatttatcgtttccgtggcgcagatatttttacttatctaaaagcctcagacgaagcccaatctcgctttgaactcactaaaaattatcgttcagagaagcatttggttgatggtgtaaatgctttattcgattttcctcaatcgccatttatttatcaaaatattaaatttactgctgttgattctcgtgatgatcatctgcgattttatttaaatggcaaagccgaaccagcttatcgtttttatctaactgaaagtgacaaagtgaataaaactgaaatggcaaaaatatgtgctatttctattcaacattggctaaaaagtgcggctgaaaatcaggcagtttttcaaaatgaagatactcgtaaaacattgcaagcggcaaatattgccgtattagtgcgtgataaaaatgaagcggctttagtaaaaaatgaattgcaaaaattagggatcgcgtcagtttatctttctgatcaaaatagcgtatttgatagcaatgttgcgaaagaattagcttgggtgcttaaagcctgtttgaatgtggcagaacgtccaattttgaacgcgattgcgaccgcactttttggcttaaatgcagcggatattcatcaaattcagcaaaatgaagcagattggcaacgttgggcagatagttttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaatcggcattgctcagttggtttgaaaaacaaattcaaggcgaaggtcgtcaagaggctcaaattcgtttagaaagtgaacgccagttggtaaaaatagtgacaatccataaatctaaaggcttagaatatgatttagtttggctaccatttttagctgtgccgagcaaagatccaagtaaaaaagacatcaatatttattattctaaagaacgagatgaaaccttatgggatatagaaaatcgcaatttaaacgctctttgtgaagaaacttttgctgaagaattacgtttactttatgtggctttaacacgtgccaaatatcaaatggcattcgcgttgcctgcacaatttgataaaaaatggaatgccttacattatgtattaagccaaggtgaaataggcaaggaaataaatttgtcgaattctaaagataccgagacgttgttgcaagcctttaaagaaaaaatgcgagataatgtggaaatctgtactaagccaaatctagaggcttttccggctttatctatcaatacaaaaaatgatgagcttaaagccgcagaatttacgggcaatattgagcaagattggcgaataaccagttttacttcaattgaacaaggtcatcgccgacaaaattatttcgctgaaagtgcggagaaaaaacacgctgtttttgatgacgcaaaagattacgatagtcaaaatgctattgaaatatccaccgcacttttaaacgaaaatgaatcaaatattttagatttaccacgaggtaaacaagtcgggactgcattgcatcgccattttgaaaattgctatttttctgatttagcaaatatagaagaaattgacaaattaagacaatccttacagttagatgaaacttttacagagccgctacaaaattggctacaacagatttcacatacgccactttctcatgaaataggaatagcattagctgatttggcaaataaagattgcattaaagaaatgccattttatctggctatttgggaacattttgatgttgaagagtttaatcgcacattgaaagcccatcatcatttaccaagcgagccacttcaatttgagcaaattcaaggaatggtgagaggttcaattgacttagttttccgccataatggaaaatattatcttattgattataaatctaatttcttaggttcaacccttgctgactacaatcaagaggcattgaaaaaagaaatgttacacagtcactatgattggcaatatttaatttatacgctggcattacatcgttatttacaaagcgttgtgcctcattacgattatgcacgagatttcggcggggtattttatcttttcttacgtggaatgaacggtgaaccacaatctggcgtattttacgatcgtccaagcgttgaattaatcacagaattagacggggtgttttaatgttatctgtattacacaaacttaaagagcagcgcattctttctcaaggtgattattattttgctaagttgatagctgataaacaatgtcatacggattatgcggaaccaatcaaaaatttagctatattattagccgcactttgtagttggcgttatacgcagggaaatacttgcagccaattagatcgctatttagaacataatttatttggcttggcttatcgcactacagaagaagactatttagctgaaattcgtgaaaagattggttatttagctgtggaagattggcaaaatgcgttgtgcgggcatatggcatttacgcaagatcccgtcaatcaaattgcaccaatggtatttcaatttggcgcgttgtatttctatcgtacttggcaagatgaatatcgtatcgcgcaatatataaaaaacactttaaaaaaacaccgcactttagccttttcttatgatgaaattcatcaaaaattagagaaatatttccctgaaaaacaggaaaaaacagattggcaaaaagtggcagtggcgacagcgattaaaagtccattttcgattattacgggtggcccaggaacaggaaaaaccacgacagttacgcgtttattgctcgttctacaagaattatttgattgtaaattacacatcaaattggttgcaccgactggcaaagccgcctcccgtttggaagagtcgattaaaaatgcgttaggttttatgcaagaaaaaatgaatgtatcccattcacttttcaatgcgattccacaaaaagccagcaccttgcatagtttactgggcgtgaacgcctttaatgattacacgcgctataacagccataaccctttgcaattagatgtgttagttgtcgatgaaacatcaatgattgatttgccgatgatggtaaaacttatcaatgcgttaaagcccgaaacccgattaattttattaggcgatcaggcacaattagcctctgttgaggcgggggctgtattgggggaattagctcaatttgttactcaaccttatagtcatgaacaagtcgcatacttactagcaacaacaggctacaaagtagaaggttccgattgttcaaatccaatacgtgattgcttatgccatctaacagaaagtcgccgttttgataaagattcaggcattggaaaattggctgaattcattcaaaaaggcaaagcagacgatagccttgagttatttgaccattatccgcaagaattgcactttaatgccctaaatgatgaaagcgatgcggtcaatcaagtggtgaaaagtgcggtggaaaattaccgcactttcttaaaaatgttggacgatttacgtaaacaaaaaattgatcctaacgctaaaaatgaacaaggcatttcctatgccgaagccattcaagcgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaatgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttccgaatttgaacacactgtcatggtgcttccaacagaagtaaatccagtactgtcgcgagaattagttttcacgggcgtcactcgtgcgaaaaaagaactcactgtatttgccgatgaaaaaatatggaaaacagcgattcgtcagaccgtcaaacgccagagcggattgggaaaattattggaagatttaaattagtaaaaggcggtaaatttggaagataaatcaatcagataatctccatttaaaataacttttggggaagattattttaataaattcttcaaactggttttcattgctgccatttgattttcaaattgtgccttgctttctctttcgtcaatcatataggtaattgtttccgaaagtgtcatcttcatttttcgagaatatttagaaagacgtagccaaacagcatattccaaatcaatggattttttcttggtatgttgtttttctccattaaaaaagcgtttacggcgggcacgaatggcttgatcaagcttaattggtaaggctggagaaagatgatttttaatccattcttcaatttgtgaaggataattttgggattctaataattcttgggctttagcttcttgcaaactacgttcttcgtagcgagtaatattttccccttcgcgatgtttacgaattaggtaaatccatttccaatttgattcttgattttcgagtttttggtatttcattttttatcattgagtgacgtggtaactgcattaatatacgtgtttttatgccgattttctagtggattttcacaaggctattaaatatgcgataatgtggtcaatttttctagaaagagaccagccgtgagttcattattttctcaacaacaagctattgagcaatctttaaattggcaggcattacaacctgatttggtaattcaagattttcctttagaaccagtggatttctgggcgttacaaccgaatgctacacagggtatcgatttatttttacgtcatccgacacgttccttactaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggagaggcgttaagtgcattgtattgcgatcaattccagcttttcggtagttttcggattcatccaagttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgagttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcttcaacttttgctgaaaaaactgcattaagtgcggtggattttgagggtatttttcaacaaaaattagcacaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggcatgatgattgcgcaagcttgcctttccaatatcttagatttgccctcgcaattgccattttctgcctcattagtgtttgaacagtcttatggtgaaattgatggtgatagtgcatctttggcgattttctgtgtgctagcaagcgctttagctgatttgcctttgcctcaacatatcgcaattacaggatcgattgatcaatttggacttgttcattctgttggtggtgtaaatgataaaattgaaggcttttttactatttgccaacgtcgcggtttgactggaaaacaaggtgtaatcattccaatgacgactattcagcaactgagtttgtctaatgaagtgaaaagtgcggtaaaaaatggcgagttttttatttatcctgtggaagatatttatcaggcttgtgaattgttatttgggcgtgatttgttagatgaaaacaaagattatacagaaaaaactgagcctttatctcgtcttattcaacgtcgtattgagggacgtgccgattctgaacgaaaaagtttttggcattttttccgctcctaatagagaaaagcgagcattttttcgcttttctttttttctataatttctaagagtgactgctccgacaagttttgcgaacaagtgttagctatttacagtttactgcgttcattttaaaatagatatatcagttataaactggatttatcatatataaaggaatctgaaatgcaaaacacttgtacacttaataaaaaaaatagctattcttatgatgatttgctcgcatcaggtcgcggcgaattattcggtaaagaagggccgcaattacccgcgccaacaatgttgatgatggatcgtatagttgaaatgaatgaagaaacaggtactttcggtaaaggatacattgaagccgaacttgatattaagcctgaattgccattttttggctgccatttcattggcgatccagtaatgcccggttgtttaggattggatgcgatgtggcagcttgttgggttttatttaggctggattggtggcaaaggaaaagggcgagcattaggggttggcgaagtgaaattcactgggcaaattttgccgacagcgaaaaaagtagtttacagaatccatatgaaacgagtaattaatcgtaaactagttatgggaatggctgatggcgaagttgaagtagatggtcgtgttatttataccgcgacagatttaaaagtaggactattccaagatacctcagcattttaatttttctttattaatttatataaaagtgcggtgaaaatttttcttagattttcaccgcatttttccttattaaattgtaataaattcttaaaatatctataatattcttgctattttttcaattttattagtagtaaataaaatttattttaaagctttttaatagacgttattatagaaaataataaattaatttctatttaaactataaataatatactgaagtagtgggaatatgatggcaaatgatgattttcaagaatatgtgaagcaactggtaacaaaacatcgagatgaacgaatttatccttttcaatatgaaggaaaaaaatattggttgaaacaacctgaaaaattgaaagggatttggctattattaaaaccccatcctaaaaaatcttttaaaaatgaattacatactttattgaagcttgctgaacaaaatgcgccagtgccaaaagtctcttattatagtgatcatttttttgtgttggaaaatgtgggactgactgtatcacaatggctatgcaataaaaatatagatgaacaacagaaatttttaattatttatgatgcttgtctcgctttgattgatttgcacgctaaaaatttgatacacggtcgtcctgctattagagatattacttgggataaagggaaggttacttttcttgattttgaatctcgtgcaaatagtcaaaatcaaaattgggtagttattcgggatatgttatttttctttgatagtttatgtcgagaagaagatatttcagacgattttattcaaaaagtagcgttgtattatcaagcttattgtagagtagaaaattggcagaatatgatcgtatttttgcagcgttttcgctgggtttattatcttttattgccttttaaaccttttgcaaagaaagatttaattgcagtttatcgcttatttgaaattttattaataaagaaaaaatgatgaagaaaatattttttatttttgtattatcaggcatattagctgcttgtgccatgggtggtggtattcgtgctggtggtggaagtaatggtgtaggattaggtgtggggattggatctggcattcgcttctaataatgaaaagtgcggcaagtttgatctttatcttgcattttagcgtattcatcgctagaatgcgggctccttatcatcgctgagttagagatcggcgaatgatgtattaacaacactaccttttaggagtaaaaaatgtctctaagtactgaaaaaaaagcagcaatcgttgctgaatttggtcgtgatgcgaaagatactggttcttctgaagttcaaatcgcattattaactgcacaaatcaaccacttacaagctcactttgcagagcataaaaaagaccaccatggtcgtcgtggtttattacgtatggtttctcgtcgtcgtaaacttttagactacttaaaacgtactgatcttgctttataccaaagcacaatcgctcgtttaggtttacgtcgctaattttttattacgatagtaaaaaatcaagccctagaatattgagggcttttttatggggctgtactagataactagaccaaactccccttaactaattgttttaaaatggaaatttgagattttatttcgctattgttaaaacgccattcacattcttttaaatacagctcaaaatgctctttgggaatgccattaaacttctgtaaatggcgttttgcgtgattccaaaaattcccaattccgtttatgtagttgtgattttcagcaaaatgcgtgctgtgattgatgcgaaaatggctaaattcactgacatcaagcatatcataactacgaaaggtatccgtgtacacaatgctatcaggcttaactttctttcggataattggcaataatgttgctgattgcacattaggaacaacgacggtataaaccttgcatttcatttgagaagcccgaataccgcgactttccctgcaacactgcgaccacgtttgccttttcgagtactgccgaaatagctttcatcggcttcaattttgccttcaaacatttccaaatgtgggcttgtttgataaatgagtaagcgtaatcgatgaaagtaatagtggctgtatttttgtttacattaaccaatttactggctgttcttgctgtgacacctgcgacaaacagttcaatgagtttattttgtttatgctgacttaagcgactttttctcattggtttattctaacctaaatgggatttttagttgttatctactacagcaccttaatatttatagagttcgttatataaattacgctcgaattgtactaatggggcacgttttgttttgctttctaaatcgcccgttgagtagccattaataaattgtacaaatgccactttttcccctcgcgcatttgtcataaagccagctaggttataaacgcctttcaaagaaccagttttagcaatcacgtttttcactaatggtgggctaattaatccacctcgcccactgatcgtgccatctacacctgcgatgggaaaagtttccattaaatgtaatttatcttcgtttttggcgatgtattctaaaacggatagcatcgttttaggtgccacaagattatggcgagatagacccgaaccatcggctaaaatgctattaccaaaacgaattccttgtttttgcaatatggatttaaccgctaatgtgcctaattgaaaggaggcggggcgtttatagtaattgaatgccaccgctcggaataatgaatcggcaatttggttatccgattttttcatcatttttttcaataaatcaggtaatggttttgataaatgtttcgctaatagctgaccttgttgtggtttttggggtaacaagactttgccattgaactcaatacctaattttcttaattgacgttgaataatcgcggcagcataagcatccgtattttgcacggcaaaacttaagccaaaaggtttatattgacgggctaaacatccttttacttgatagcgattattgtcgtgtacaacaacatcgagctgacaataaggcgcttcattgctatccgctacataaacttgtccgaacacttgaattggaaattgtgcaggcacattaatttttactatttcacctggatttttattcgcatctagttccgcataaaaacagttgttatcaatattcgcagctgctggtggagagttgaaacacattgtgagatcgttccaaatccaacctaatcctcggtcgtgactagaaaaaacagaggtatctaatactaaatcgccattaatttttttgatgccttgtttttttaattctgcaagtaagctataaagctgacctcttgtgagatcaggatcgcctgtgaaactcacgattaagttgccatctaaattcccattttgaattttcccattactcaaaagtgcggtctcaaattggaattgatcgcctaatgcaagtttagcggcaacggctgtaaaaactttttgtgtactcgcaggcagcataaaggttgagccattataatcagcaattatttgattttgattgatatttttagcaataacacctgcgttagagccttcaggcaatttttgtgttaaatctgaaacattaatattggcgaaagttggtaggctaaaactcactgaaagtaaaaaggaaccaagtgcggtggaaattgaagataattttttcatattaggtttgttatggttgctatttttttttagacgaacaataataagccccgaatgaaattgagtaaatcattttctcatttcaagtttatttttgataatactgcagtaagattttagaattttactgtggtttttgttttatttagtaaaaggaaaaacaatgcaacaaattccaatgactgtgcgtggcgcagaacaattacgagaagaattggatttcttaaaaaatgtacgtcgtccagaaattattaaagccatagcagaagcacgcgagcacggagatttaaaagaaaatgcagaatatcacgcagcgcgtgagcaacaaggtttttgtgaggggcgtattcaagagattgaaggtaaacttggtaatgctcaaattattgatgtcacaaaaatgccaaataatggtaaagtgatttttggtgcaacagttgtacttgtaaatacaaatacagacgaagaagtcacttatcgcattgtaggcgatgatgaggctgatattaaatctggtttaatttcggtaaactcgcccattgcgcgaggcttaattggtaaagaattagatgataccgttaatattacaacgcctggtggtgtcgttgagtttgatattattgaagtgaattatatttaaataaaaaagtgcggttaaaaatgaccgcacttttgttgttatttgcgtggaagctgaatttttgcttcttcgcttgggcgataaagcaccaaaatatgcccgatagtttgtacttgtgctgctttagtttcacgcacaatcgcattgataataagttgttttgtttcacgatctgcaccagcaacttttactttaatgagttcgtgatgattaagtgcattttcaatttcagcaagtacgccttcggttaagccatttccaccaagcataacgactgggttaagatggtgcgcaagaccttttaaaaattgtttttgtttggttgataaggttgtcataaggatccctaataaaaaagagcggttgattttctcaatgttttttactgatttcaatcagcttcggcttgaatttgacagattgtacccaaatataggcgaaacgactacaaaaaatagaagattatgggaaagaaaaaacgttcagcgagttcttctcgttggctgaatgaacattttagtgatcaatttgtgcaaaaagcacataagcaaaagttgcgatcacgcgcttattttaagattgatgaaattcagcaaacggataaattatttaaacaaggaatgaccgtggttgatctcggtgccgcaccaggcggttggtcacaatacgtagtaagccaaattggtggcaaaggtcgagtgattgcttgtgatattttagaaatggatcccattgtaggcgttgattttctgcaaggtgatttccgtgatgaaaacgttttgaatgctttgctagagcgcgtgggcgaagctaaagttgatgtggtaatgtctgatatggcaccaaattttagtggaatgccatcagtggatattccacgcgcaatgtatttggtcgagcttgctttagatatgtgtaaacaagtcttggcaagcaaaggaagttttgttgttaaagtctttcaaggggaaggctttgatgaatatttaagagaaattcgttctttatttaatgtggtaaaagtgcgtaagcctgaggcatcacgtggacgatctcgtgaagtatatattgtggcaacaggctataaaggataattgctttgatagcttttcattgctaatgatgtgtagtatcttgtgacgaaattttttaacttaggaaaggtaggttagactttgaacgatatggtcaaaaatctagtgctttgggtggtagtggcagtcattatgatgacagcataccaaagtttcaattcatcttcggtagaaaattctactgattatacaacctttgtttacgatgtaagcaacggacaagtgacagcggcacgttttgatgccaatgaaattacggtaacgaaaaccgatggttctaaatattcaaccgtaatgccaccacttgaagataaaaaattgcttgatgatttattaagcaaaaaagtgaaagtggaaggcacgccatttgaaagacgtggttttttatcccaaattttaatttcttggttcccaatgttattccttgttggtgtatgggtattctttatgcgtcaaatgcaaggcggtggcggcaaagcgatgagctttggtaaaagccgagccaaaatgttgaatcaagatcagattaaggtgacttttgcggatgtggctggttgcgatgaagcaaaagaagaagtgggcgaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggcggcggacacgatgagcgtgaacaaaccttaaaccaaatgctagttgaaatggatggctttagcggtaatgacggcgtaattgttattgcggcaactaaccgtccagatgtacttgatccagctttaactcgtccaggccgttttgaccggcaagtagttgttggcttacctgatgtgaaaggtcgtgagcaaatcttaaaagtgcatatgcgtaaagtgtctgttgcacaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtacctgagcatgatcctgtacataaagtgacgattattcctcgaggacgtgcgttgggtgtgacattcttcttacctgaaggtgatcaaattagtattagccaaaaacaattagaaagtaagctttctaccttgtatgcagggcgtttagcggaagatttgatttatggtgaagaaaatatctcaacaggtgcatcaaatgatattaaagtcgcaactaatatcgcgcgtaatatggtgacgcaatggggattctctgaaaagttaggtccgattctttatacagaagatgagggcgaggttttcttaggtcgttcaatggcgaaagcgaaacatatgtcagatgaaaccgctcatgcaattgatgaagaagtgcgtgcaattgtaaatcgcaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagcctgaaagtgcggtagaaaataccgacaattttaatgtttaacttatcaaagcctttcttcggaaaggctttattttttcctaatgatttttttcttggatgtatttcgctataatcgcccaccaaaatcactctaaaaattaaccgcactttatgaaactttacgcaaataataaatgtcttgatttaagcgttcctaagattatgggaatccttaattttacgcctgattctttttctgatagcggacagttttttagtttggataaagcgctttttcaagttgaaaaaatgttggaagaaggggcgacaattattgatattggtggtgaatctacgcgtcctaatgatgcggatgaagtctctgaacaagaagaattgcatcgtgttgtgccagtagtggaggcggtgcgaagccgttttgattgctggatttctgtcgattcttcaaaagcagttgtgatgcgtgaagcagcaagtgttggaatggatttgattaatgatattcgtgctttgcaagagccaaatgcgttagaaaccgcagtaaaactagctttacctgtttgtatcatgcatatgcaagggcaacctagaacgatgcaggcaaatcctcattatgagaatgtcgtacaagatgtattcgcttttttacagaaacgtactaatgaatgtctttctgctggtgttaaaaaagaaaacttaatttgggacatgggattttgttttggtaagtctgtacagcataattatcaattattacaaaatctgaatgaattttgtcatagtggatatcctgtgttagcgggattatctcgcaaatcaatgattggtgcggtgcttgataaacccgtcgatcagagagtgataggtagtgcggcaggtgcgcttattgcagcgcaaaaaggtgcaaaaattttacgcgtacatgatgttgctgcaacatcagatatgctcaaagtttggcaggcaacagaaaatgcctgatggttttataaaaaaattaaaggaattgtattatggcaaatcgtaaatattttggaacagatggtgtacgtggaaaagtaggtagttatccaattacaccagatttcgcattaaaattaggctgggctgcgggaaaagtattggcttctcaaggttctaaaatggttttaatcggtaaagacacccgaatttctggatatatgttggaatcagcccttgaagcaggtttggctgctgcgggtttatctgctgcatttactggccctatgcctacacctgctattgcttatttgaccagaacttttcgtgctgaagcgggtatcgtgatctcagcctctcataatccttattatgataatggcattaaattcttttcagcaaaaggcactaaattgcctgatgaaattgaagaagccattgaagcgatgttagagcaaccgatggattgtgtggaatctgccgaattaggtaaagcaagccgtattaatgacgcagcaggacgctacattgagttttgtaaaggtacatttccagcacacttaggcttggaaggttataagatcgtggtagattgtgcaaatggggcgacttatcatattgcacctaacgtattgagagagcttggtgcggaagtcattgaaattggtacagatccaaatggtttgaatattaatgaaaaatgtggtgcaactgatgtgacagcattgcaagctaaagtagttgaaacgaaagctgatgttggtttggcttatgatggcgatggtgaccgcattatgatggtcgatcatttaggaaataaagtcgatggcgaccaaattctctttattattgcacgtgaagcattgcgctcaggtcaattaaaaggcggtgtcgttggcaccttaatgagtaatatgagcttagagattgcgttgaaaatgcttggtgttcccttcttacgtgcaaatgtgggagaccgttatgtattggaaaaaatgcttgaaaatgattggacgcttgggggggagaattctggacatattatcattgcggataagaatacaactggcgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgtgttatggtggaatgccaagatgctgaacttgcacaacaatgtgcagaagaaattgcagaagccgtgaaaaaaattaattaatttttgaccgcacttagtaaagtgcggtttatttttataaagtttttaggaaagcaaaatgaacatttttattatgcgtcacggcgaatcggaagtaatggctaatagtgataaagctcgtcgcttaactgcttatggtattaaacaagctttttctcaaggagaatggttaaaacagcatttaagcacgctagtaattaattcactagaccgtattttagtgagcccttatgtcagagctcaagaaacctttcatcaagttaatcaagcgtttgatttggagttagaaaataaatttgaaatttgggagggaataaccccttatggccatgcacattccgtcattgattatttagaagtgctaaaagacgagggcgttaaatctgtattgattgtttcccatttgcccttagtgggagaaattgttgctgaactgtatggaaaacgaaatccaatatcattttatcctgcaactattgctcaattattatgggatggtaataaatcagaaatattgatgcatcaagcatctcctgtaatttatttaaaataaactattctttttttacaaaaaataaaatttttattggttttttatataatctattaaaaatcagtatcttagatgttgttttataaagtaatctttttaaagaaaggtaaagttttactattattgtttttctttttatgaaaattcccgtaaactaaactgcatcaaagtaatagggctttgtaataatcaaattattctatggagaaaataatgaaaaaattaacattagcattggttttaggttcagctttagccgtgacaggttgttttgataagcaagaagcaaaacaaaaagttgaggatacgaaacaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaaacagcatcagaaaaagcaactgaaataaaagaggcagtttcagaaaaagcaagtgagatgaaagaagctgcatcagaaaaagcaagtgagatgaaagaagctgcatcagaaaaagcaagtgagatgaaagaagctgcatcagaaaaagcaagtgaaatgaaagaagctgcatcagaaaaagcaagtgagatgaaagaagctgcatcagaaaaagtaggcgaaatgaaagaaaaagcaactgaaatgaaagaggcggtttcagaaaaagcaactcaagcagtagatgcagtgaaagaagcgacaaaataataggtttaatttaaataacaaaatccctgttaaagaaatttaacagggattttttatagattaatccaatttgatttttacaaataatatcccgccattgagctatataccgcattttcactttgtagcacttgatattttgcattcaaaatcgcaagttgtgatgatttttccgtattggctgcaactaaccattcgcgcaattcggacacgcccgcattatagcgatttcgataatattgtgtgatacgctgattgtaactatgggtttgctgtaaattacttaatgtactttgcgcttgggtaaaggcaaaatagttggtatccacattattgagagccgtggtaatacgttgttcgtaatttaaacgtgctgtttcatagtcagcttcagaaattttaacgttccattttacggtgttccaatttaagaatggcaagctaattcctactgtgccagcagccacagggttatgtaatgccgtaccaactgtgcttgctgttgaagaaaggcttgcacctaaattaacctctgggaaccaacttttttgagttgctttggcatttttgaatgcactgcttaaacggaattgtgctgcttttacatcaggacgatttgcaattacagacacaggcacgtttaagtttacgcctgccgttttcacattcataatatgtgggaacgtgatatttaatgcttcatttggttttaggttgagaagattacgcagtgtttgttctgctgttttgcgttgggtttcaaaatttaatttgttattacgcgccgttaatatggcttgttgagcttgatcaacgctggctgcatcagccacgccttgcgctaaacgcgtttgcataatattgccaatatccgtgtaatatttgatcgtttcgttggttgtgctaatagcatcatttaaataagcaatttgataataagttgttactacagaattgattaatgataaacgagccgattccatatcttctgcagttgctttgtgcgaccattccgccgcatcaacagtattggccaaacgttgccacagatctaatgtatagctcacatttaaagaacctttgtgtgaagtggcagagtttgtactgatatcaactcggcgttgtgctgctgatgaagttgaaccattaaatgcaggcactaaatttgcacccactaaattcgcactataaagcgcacggtttaccgctacagcagctttagctaaatctttattgtttgttaaagcttgctctataacacgatttaattgcgcatcatcatataacgaccaccaattttcttttacattatattgcttggtaatttcttcatattgcttgtaatcttcaaggcttgcttgataagaatcgccaatattggcacatcccaccaatgcaccagacatcaacaaagcaagcgtgatatttttcattttaaacattgaattttcctttctacgaactaaaaagtgcggatgattttaaccgcacttttttatttataaaataaatattgtgacttttatttataatgaatgtttgttcagaggcaagtattttaaagttaaatattggaatttgcacgaaaaaatttgtatttcctttacatatcaatttatttaacgtaaagtcacgcttcttttttgttttatcctaggaggatataacatgttttattacaattctgcaagcaagcaagcaagcaagcaagcaagcaagcaagcaagcaagcaagcaagcaatgctaatcttttcttttcatctgtcaagccaaccatgacagcttcacttatcagcacagtttgctgatctcttctcaagcctttgcggcgagtgacaattcaattagtacgaattacggcattaaagagtttggggcgtatagcctgatcattggtaatttaaagaataatacaattaatagtaaaatttccaatcaggctttaacgagttaaatggcaaaattggtaagttagacagtaaattagaacgtggtttagcggcggctaacgccctttctggtttagaattgccacaagtggttggaaaagcgagtttttctgctgcggtgggcggttatggcagctgtaatgcgatggcaattggtgtcggctacacactaaaagcaaatatcaagttaaaaagcggtatcaattattcttttcttaaacacctgattttttcctaacttcgcaaaatagattcaatgtaaaatttttcattttaaatttccttttttgagtgtaaaaatagctaccttagtatgttaaaggaagtgggtttcatttcttatataagttttaaaggaattaaaatgaatgttatttctgatcttgagcttcagcaaattcgcactcaaatgctgacatttgcacaattgcaagtaaatcaagctgatcttgctgaagatttagtacaagaagcctttttaagtgcattcaaaaatcttgataattttaagcatcaatctgcatttaaaacttggatttttgcgattcttaaaaataagattattgattatttacgtcagaaagggcggtttgttttagaaagtgaacttgaagatgaagataccaataattcattttttgatgaaaaggggcattggaaaccagaatattacccgagtgaattacaaggcgaagaagaaactgtgtattccgatgaattttggctgatttttgaaacttgtttgacttgtttacccgccaaacaggcaaaagtttttatgatgcgagaatttttagatctttcatctgaagaaatttgtcaagaaacgcatttaacttcgtctaatttacataccaccctttatcgggctcgtttacagttgcaaaactgtctttcaaaaaaactttaggagaaaattatgcgttgtcgccaagccactcgaatgatttccgaatcgcacgaacgttcattagatatacaagaaaaagtagggctaaaagtgcatttagctatgtgctcgcgttgtcgtcgttttcaaagaaattgcaaaaccttaagtatgatgatgaagaaatttaaagattcacattaagagtgatgaaagtattaaaaaatccgctattttgaccgcactttatagcggtatttctaacttatccatacggcattttgtaatctcaaaggttttatttcttcagcttcgccaataaactcactgcgcccacaattataactgcaccgagccaaaaatagaggttaggcgtatgatgccaaaagagccagtcgaaaacgctagagaaaaccacgccagtgaaagcaaaaggagtaatgatattggcgggtgcgtatttaaaagcgcgcgtgagtaataattggaaaatcaatccgaaaccgcccaccaatagtaataagccaagctcgtataaattagggattttccattggttaataaagaagactggtaacatgaacgtaccaatcagatgaaaataaaatacgatattttttggtgtgttgtatttgtttaattcttgtaagccaataaatgccattcccgctaatacagcaccagataatccaatcagcacataaataggatcaacattgccattgtgattggtgagtaaaataatggaaacgccaagaaaaccgattaagctacataaaagcacattaagcggtgttttttgatggaaaaaaagcaataaaatcgggataaatagggcagaggtattcatcaataagacagcgatggaaagcggtaagaacttcacgacataaaagttaatcaacatattcgatacacccgcggcattacgcaggattaaaaatttccattgacgagtatccactttaaaatcgcgatctttaatcacaaaaggaagtaagaaaagcaagccgattaaaaagcgtgaaaataaggtttcacttgcagggattgtttgagaagccgttttgacaaatacattcatcaaggtaatggaaaagtacgctgataccataaaactaatcgctttgtgataaagtgaaggaatggaatgtgattgcatatagatttttaccttagaaaagagggggagattgggcatcttaacgctttattattggttataacaatggattttaatcaatttctttaaaaattttgcaaaaatctgtaagaaatcgaattatccgccgtctaaccttatgtaacgttaatttttacttcataaggaaaagcaatgaaactatcaaaaacatttctatttattaccgcactttgcagtgctacaccaactttagcaatacaaaattcaacatcatcatctggagaacaaaaaatggcaatggaaaatacacaaaacatccgagaaatttatcttgctggtggttgtttctggggtatggaagcatatatggagcgtattcacggtgtgaaagatgcgatttctggctatgccaatggtaatacggggaaaaccagttatcatatgattgggctaaccgatcacgcagaaacggtaaaagttacttacgatgcaaaccaaatttcgttagataaattgcttaaatattattttaaagtgattgatccaacgagtgtaaacaaacaaggtaacgaccgtggtagacaatatcgcacagggatttattatcaagatggggcagataaagcggtgatcgaacaagctctcgcccagcttcaaaccaaatataaaaaaccagtgcaagttgaggtacaaccgattaaaaattacatcgtagcggaagaatatcatcaagattatttgaagaaaaatccaaatggttattgccatattgatattaccaaagcagatgaacctgtgattgatgaaaaagattatccgaaaccgagtgatgcagaacttaaagcgaaattgacaccgttgcaatattccgttactcaaaataaacatactgaacgctcttttagtaacgaatattgggataatttccaaccgggtatttatgttgatgtcaccacaggagagcctgttttctcttcaaatgataaatttgaatcaggttgtggctggccaagttttacgaaaccgatcattaaagatgtggtgcattatgaaaccgacaatagcttcaatatgcaacgtaccgaagtgttaagtcgtgcgggcaatgcccatttaggacacgtttttgacgacggcccgaaagataaaggcggtttgcgttattgcattaacagtgcatcaattaaatttattccgttagctgaaatggaaaaggcaggatacggatatttgattcaatccattaaaaaataaggagatgtaggatgttagatcagcaactccttattggaactgtatttttagctgggcttgcttcttttctttcgccttgtattttcccgattattccaatttattttggtattttgagtaaaggtggtaaaaaagtcctgaatacttttttatttattttagggctttcccttacatttgtcagtttaggctttagttttggctttttagggaatattttatttagtaacactacccgcattatcgctggcgttatcgtgattattttgggtattcatcaacttggcatttttaaaattggtttgttggaacgcacgaaattggtggaaataaaaacatcaggaaaatcgaccgcacttgaggcatttgtgcttggtttaacctttagtcttggttggacgccttgtattggcccgattctggcttccgtgttagctttatcaggcgatgaaggctctgcactttacggtgcatctatgatgtttgtttatgtcttagggcttgcgaccccgtttgtactgttttcgttcttatctgacagcttgctcaaacgtgccaaagggttaaataaacacttagacaaatttaaaatcggtggcggaattttaattatcgtgatgggtattttattaattacgaataatttttcgtaagacataacctcaacaaaagaaacctataactaaggaaaaaagcaatgaaaaaactactatcaatatttctaatggcattcagcctaaacgcttttgcacaaactaatttagcggatgtgcaactcaaagatttaaacaatcagccagttactttaagccaatataaaggcaaacctgtgtatgtcaaaatgtgggcatcttggtgtccgatttgcttggctggattagctgaaattgatgatttaagtgcggaaaaagatcgcaattttgaagtgattaccattgtttcgcccgatcacaaaggcgaaaaagacaccgctgattttattgaatggtacaaaggattggaatataaaaatatcacggtgcttttagatgaaaaaggcgaaatcattgacaaagcaagagtgcgtggctatccgttcaatctctttttagatagcgatttaaacctgaaaaaaaccgtaccagggcatttaggtgcagagcaaataaaagtttttgcagggaaataatgatgaaaagcggcttatttttaagccgcttttttatatcctcgtttttacataataaagagataaaatatcctacatagaaagtttgttcattgagcgtttggtagattgataaaaaatatatattataagcggtatgattttattgcttgtataatagttttttatttttacgttatcgttactttttccaataacgtgaaattcgcgatcttcttctcggtgagaaattaagaatttagcaaagacatcatccatttcatcttgtttattgactaagcccacccacacttcagcgtattcttcaggatcaatcagtacaccaatttcttcttcccaatcatcggcggtttcaacaaattccacaccaccgcgttcttcaaattgtaggttgaataaaagaatataggcaggatctaaattttctccagccatttctaagaaaatatcgtaagcaatatcaatggctgtatcgggatcaagttttttaatttctgttgtcatagtgttttgtcgtaaaggttatggttaataaaagtgcggttaaatttttttctcttttgaagcgttttattccatattggttggaagtttaatttctcgaatattcatcgaaaaaccgtcaatcatcaataagcgtccacacaaattcttaccgatttttaaccgcactttaattgcttctaaggcttgaatgcagcccacaataccgacgattggtgcaagcacgccagcttccacacagcttaatacattttgtccaaataatttgctgagatcacgataagtaggcgtatttggttcataagtgaaaacggaaacctgaccttccattcgaattgcagcaccagaaataagaggaatttttgcatgattacattggcgatccaattgattacggatttccacattgtctgtacaatctaaaacaatatcaaagtgcggaatgatttcagccagtttttcttcgtccaacttcgcattaatcgtctctatgtttatatgtggattgatttgttccagtgcaattttagcggattccacctttggcatattcaagcgcgtatcgcagtgtaggacttgtcgttgaagattcgaaagcgaaactgtatcgaaatccaacagtgttaaatttccaacgcctgccgctgcgagatattggctggctgcacatcctaagccaccaagcccaacgatcagcattttgcttgctttaagtttttcttgcccgtcaaaatctacgcttttaagaataatttgacggttataacgcaattcttcttcgtgactaagttcgatcattttttatcctaataaatgattgaaaggctcaattgtcactgtttcgcccgcagagacattgccacgttcttgttctaacacgataaaacaattgctttttacaaaagcactaaagagatgagaaccttggaaacctactgattgcacttcaatttgaccttgttcattgatgtaataaaaaccccgttggaagtctaaacgtcccactgcttttttcaaattcattgtagcaatggctgaaaagtgcggtggatttttccattgtttttgtccttgcagtttagcgattaatggctgtacaagttgatagaatgttactaatgcggaaacaggattgccgggtaaaccacagaaccaagcattttctaatttaccaaaagcgaatggtttgccgggtttgattgcaattttccagaaatttactttgcctactttttccaatactgctttagtgaaatccgcttcaccaacggaaacaccgccactggtaatcactaaatcggcttggctttgtgcggcaataaatgctttttcaaattcagcttcgttatcaggtaatagtcctaaatcaatgacttcacagtttagtttttctagcagtaattttacggtgaaacggttagtgtcatatatttgtccgctttgtaatggcttgccgacttccacaagttcatcgccagttgagagtacaccgacttttaattgacgatagcattttacttctgcaatgcctagagaggctaataatggcaaggaaactggggtgagcggtgcgccttgttctaatacaacatcccctttttttacatcttcaccaatacgacggatgttttgatttggtttaggtaattcactaaaagtgatggtgccgtcttcattgagtgttacttgctcttgcattatcactgcatctgtgccttcaggaatcatcgcgccagtcataattctgaccgcactttttgatggccattcctctttgaatggattacctgcaaaagatttccctgccactgaaagggttaaagattgttgtaaatccgataaacgtacagcataaccatccattgctgagttatcgaaagagggaacattgataggcgaaataatatcttctgcacaaattcgattggcggcttcttgtaaatttaggtattcagtttgagtcgggaagggaagctgttcaagcattttcgagcgagcttgatccaatgtaagcatagaaaatccttatttgataaaatttgtcagctattctatatctaaagcctaattcattcaaatttgcaatttttctcattttaccatcctattatcctttgctagaatagccgattatttttttaggaaagactattatgagcaaaatttcactggatgcactgaatgtaagaaatgccttgattgaaaaaggtattgagacacctatgattgatccaacacaggctaaagatgaacgtcgagaaagcattgcgaaacacatgcatgaagtaatgaagctgattggattagatttgcgagatgatagtttagaagaaacgccaaatcgtttagctaaaatgtttattgatgagatttttagtggaatggattatgccaattttcctaaaatgacgaaaatcaaaaatcagatgaaagtcagcgaaatggtgcaagtgaatgacatcactctaacaagcacttgtgaacatcattttgtgacgattgatggtaaagtttgtgtagcgtactatccaaaagattgggtgattggtctttctaaaattaatcgaattgtctcgttttttgcgcaacgtccacaggttcaagaacgcttaactgagcaacttttgacagcatttcaaaccattcttgaaaccgatgatgtggcggtatatgtgaaagcgacccatttttgcgtgaaagcacgtggtattagagatacaaatagttatactgtcacatctgcttatggtggcgtattcttagaagatagagatactcgtaaagaatttttagccacagttcaaaaataggaaatgataaattgtaatccgcacgtaaaatgtgcggatttttatttcgggaaattaaatatgctatgtgccatttataaaagtaaaaagaagttaggaagttacctttatgttgctaatagagaggatttttctttagttcccagcgttttactcgaacattttggtaaaccagaattagtgatgatgtttaatctgcttgggcgtaaagcactatacaatgtagattgtaatgaagtattggaaacaattaaacgccaaggattttacttacaaatagcaaaacaagatgatggtttatttaatagcttgagtgagatcaaataatttgtctatttataagataaaaaaagtgaaaatttgcgttatctcaaattattaaataaaaaattcctttaaaatccaccgcactttttaaaggagaaaaaaatgagtagcttttttgtcgcagggacagatacgaatgtggggaaaacaacagcagcgcgcgcaatgattcaagccttgcaagagcagggagtgcaagttgtcggctataaacctattgcttgttgtggagaagagagtatttatcctatcgcacaatcagaaaatacatctgattatgatcatttcgtaaatgctgatgtattaacgctgatgcattcaacaaaagaaaatgtgtcttatcaggatattaatagttatacttttagccactgtgcacccatgctcacgcaagataaaatgcgaattaaattagataaaattaattatgatttaacgcatttgaatcaaacttatcaatctgttgtggtggaaggatcttttggtttaatgacaccaatggcagaaggaaaaagttttgcagattggattactcaacgaaaaatgccagtagtacttgtagttggaattaaagatggttgtgtaaatcacgctttattaacggtaaaggttatccaacagttgggtgtgccgttattaggttggatagcaaatcgaattaatccattattaagccattatgcagaaattgttgatttacttgttgaacatattgatgcgccgcttttaggtaaaattccttatttacataaacccgaagaacaagaattagggcattatttaacgaatatagatcgattaatgtatatgcaaacagagttcataaaataataaagtgcggttgaatttttttagttttgtataagggcgaaatatcgcccttattttgtgtttgaaaagaaatatattattgtgataattaaggtcttacacctaacatatgacagatagcataagttaattcactacgatttaatgtataaaagtggaagtcattcacgccttcgcgagataaaatttttaccatatccattgcaacacttgctgctacaagattacgtgtagttggatcatcatccaaaccatcataggctttaactaaccacgctggaattttcacattagtgaatgatgccattttttggagttgtttaaaattagtaacaggtaaaataccgggtacgatttcagtatcaataccaattgatgcacaacgatcacgaaaacgtaggtagttttcaatatcaaagaaaaattgtataatgacgtggtttgcacctgaatcaattttacgttttaaattaattaagtctgcttgtgcggattttgcttctggatgaacttcaggataagcggctacagaaatatcaaaatcagcgacagaacggagtaattccacaagatctgacgcataaaatggttttttcgcgtaacctttaggttcgtcaccgcgtaacgcaacaatacggcgaataccactatcccaataatctctcgcaatttgttttaattcttcaggtgtggcatcaattccagttaaatgtggtgcggcttctaagcccgtttcttgtttaatggctttcacaatgccgtgagtgcggtcacgttctcccgaatttgcgccgtaagtgactgacacaaatttaggctttaagacttttaaacgatgaatggaatcccatagaagggtttccattttttcgtttttaggaggaaaaaattcaaaagagacattaatttttttattaaaatctgcaatatgttgatttaatgtatcaatttctttcgcgtagctcataaggcttcctttaggattctaaaatagtatttgtacaataaaataggttttaatatgagtcaatttcaatttattcattaaaagtatgattattattaataattcaataaatggataatgattgttcaataataattaatttttagatcaaaacgtacccaaaactaccgcacttttgttagcaatgatttatcctattttacaatgaaaaaaagtgcggtaatttttttgtatatttttatagaaagataaatgcgtgttaaataaatacaatagatttattttttagtgcaaaaaattagcattttatgaaaaaacgagtataatacgccgaccctgtaaatgtgcgaattcccatcgtacattattttatcgagatcacactcgaaggggtgatgattaagattaatggttgtgttcataagaacactgggtatcaaactaatttttggtaattaattaatgaaaacttttgtagcaaaaccagaaacggttaaacgcgactggtacgtagtagatgcgacaggtaaaactttaggtcgtttagcgactgaattagcacgtcgtcttcgtggtaaacacaaggctgagtacactccacacgtagatactggtgattacatcatcgttatcaacgcagacaaagtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtgctgaacaccaacacgctgcacaacaaccacaagtattagatatttaatcacgaggtttagaaaatggcagagaatcaaaactacggcacaggccgccgcaaaagctcttcagctcgtgtatttatcaaaccgggcagtggtaaaatcactatcaatcaacgtgaattagatgtttactttggtcgcgaaacagcacgtatggtagtacgtcagccattagagttggttgaattaactgataaattagacctatacatcactgttaaaggtggtggtatttctggtcaagcgggtgcaatccgtcacggtatcactcgtgcattgatggaatacgatgaaacattacgcccagcacttcgtgcagctggtttcgttactcgtgacgcacgtcgcgttgaacgtaaaaaagtgggtttacacaaagcacgtcgtcgtccacaatactcaaaacgttaatttttattttcgtttccaaaagaaaagcagagagaaatctctgcttttttattatttgagttactctaacttattgattataaaacaataaaaaagattatgttggcaaataggtaatgctttatggtaaaatgttgccccttaaaaacctagaatatttttggatcttcggaggaataaatgtccagcacatcaagtaaacgttcagtaatgacccttttttcaaataaagatgatatttattgccatcaggtaaaaattgttttggcagaaaaaggtgtgctttatgaaaacgcagaggttgatttgcaagctctaccagaagatttaatggaattaaatccatacggcactgtgcctacgttggttgatcgtgatctcgtattatttaattcacgcatcataatggaatatcttgatgagcgttttccacatcctccattaatgcaagtgtatcctgtttctcgtgctaaagatcgacttttaatgttacgtattgaacaagattggtatccaacccttgcaaaagcagaaaatggcacagaaaaagaaaaaacttcagcattaaaacagttaaaagaagaactattagggattgcaccaatttttcaacagatgccttattttatgaatgaagaatttggtttggttgattgctatgttgcaccattattatggaaattaaaacatttaggtgtggaatttacaggcacaggaagtaaagcgattaaagcttatatggaacgtgtgtttacacgtgattcttttttgcaatctgtaggtgaagctgcaccaaaaaatttaatggatgataaataatggaatataaatcttctcctaaacgcccttatttattacgcgcctattatgattggctagtagataatagttttacgccttatttagttgttgatgcgacttacttaggtgtgaatgttcctgtcgaatatgtaaaagatggacagattgtattaaacttgtctgccagtgctacgggcaatttacaacttacaaatgatttcatccagtttaatgcgcgttttaaaggtgtctctcgtgaactgtatattccaatgggcgcagcccttgcgatttatgctcgtgagaatggcgatggcgtgatgtttgaacctgaggaaatttatgatgaacttaacattgagccagatactgaacaaccaacaggtttttatgaagcagtagataagcctaaaaaacgagaagaaaaaaagaaaacaaaatcagtttcccatttaagaattgtggattaagaaaaaacgcgatgaaattatcatcgcgtttatttttataaattaccttgttttgcaataaagttgagaattttttcttcaatgccttttgtatccaatcctaaatctgccaatgcttcttgccgtgtcgcttgtggaataaaataatctggcaaaccaagttgtaaaagtgcggttgattttcctgatgaatttagtacttccgcaacagcagatcccgctccaccttgaattgcattttcttccaatgtgaccaaataatcgtgagtttgtgcaagcacattaatcatttcaatatcaatcggtttcacaaaacgcatatcgacaaccgttgcattgagtttttctgataactctaaagcggatggtaatagagtaccaaaatttaaaatcgcaattttttgaccttttcgaattaaacgtgatttaccaataggaagcatttctaaaggagtaagttttacaccaacggcatttccgcgagggtaacgcactgccgcaggttttccacattgataacctgtatagagcatttgacggcattcattttcatcactcggcgtcataatgatcatatttggaatgcaacgcataaagctaatatcgaatgcaccttgatgtgtagccccatctgcgccaactatccctgctcgatcaatcgcaaatagcacggggagattttgaatggcaacatcatgaattaattgatcgtaagcacgttgtaaaaatgtcgagtaaattgcgacgacaggtttatatccgccaattgcaagtcctgtggcaaacgtgacggtgtgctgttctgcaatcgctacgtcaaaatattgttttgggaagcgttgggaaaattctaccatacctgaaccctcacgcattgcaggtgtgatacctataattttggcatctttttctgccatttcacatagccaatcgccaaaaattttcgaataagttggtttactattgtttttgggcaattcgccactgattggatcaaatttaggtacaccgtggaaaccaatcggatctttttctgcgggtgcgtatcctttaccttttttcgtttttatatgcaaaaattgtgggcctttcagattacgcatattcgtaagcattgccactaattcatcaatgttatgcccatccactgggccaatatagttaaaaccgagttcttcaaataatgtactttctggcgaaaacattacacctttcatatgttcttcggtttttttcataaagtttttgattggcggaactttatcaaggatttttttactgccatcacgaagcgtagagtaaagagagccagagaaaatacgcgcaagatgattatttaatgcaccaacgttttctgaaatagacatttcgttatcatttaaaataactaacatatctgtatgcaatgcccccgcgtgatttaatgcctcaaatgccattcccgcagtaattgcgccatcaccgatgacgcatactgtttttctacctgcattttctcgttctgcggcaacggcaatgcctaatcccgcactaatagacgtagaggagtgaccaacacttaatacatcaaattcactttcttcacgccaaggaaaaggatgaataccgtctttttggcgaattgtggacatttgctctcggcgacccgttaggattttatgtggataagcttgatgtcccacatcccaaattaactgatcaaatggcgtcttatatacataatgcagcgcaacggttagctcaacagtgcctaaacctgacgctaaatgtccgctagtttgactaacagattctaaaagataagcacgtaattcttgacagagttgtggtagctgatctttatttaaaagacgcaaatcttctggagaattaattaaagataaaagaggataattgttcatattattagtcattttaaaaacgtgataaattttgaccgcacttttgtgagtgtttaactttttctggtaataacgaattcagctaatgcacgaagtgcggttgtatcaaaaggaattttttctaattcagacaaagcactttgatatagatcttgcgctttttgttttgcgccacttaatccaagtaattttggatatgtacttttatctaaatcaagatcggcacccacctgtttgccaatttctgcactatcgccttcaatatctaaaatatcatcttgaacttgaaaggctaaaccaatggcttccgcatattgtgttaaggattgttctaaccttttgtcggtaaaatgtggagaacaaatgaaacctaattttaatgcggcaattagcaatgcacccgttttgttacgatggattaattctaattcgcttaaactaatctgtttatgctcagaaataagatctaaactttgccctaagcacattccttgtacgccagcgccttgcgctaaaatttgaattaaagccagtttttgttcagcagaaatattcggtgttttggttaatatttcaaatgcgaaactttgcagcgcatcgcccgcaagaatagctgtagcttcatcaaattggatatgacaagtaggatgtccacgacgtagattgtcatcatccattgcaggtaaatcatcgtgaattaaggaataggcgtgaatggcttcaatggcagcagcagcgtaatctaaggtttgtttctctgcaccaagcatttgacctgttgcgtaaactaagaaagggcgaactcgcttaccgccaagtaataatgcgtatttcatcgcctcaagcaaaagtgcattatgactttcaatgccctcaaattgagcttctaaaaagcgattgatacgagtttgaacctgttgtaattcttcagaaaagtgacccattaagcattcccttcataatcattccctttataatcattcagtggcgcgtcttctgttttttgcaataagatctgaatacgttgttctgcttgttgtaaacgttcttgccctaacttagcgagttgcacaccttgttcaaattcttttaacgcttcttctaacggtagatcgccattttctaaatgtgtaacaatattttctaactgcgctaacgttgtttcaaaatcttgtgaagatgcgggtttacgcgccatggaattatcctttttcacggtaaaaattgtttgccattgtactgtattttatttgagttgttaaaaaattatttcaagctaggaccagtggacttttcactatctttgcgtaaaatactcgccactttaaatacccaagaaatacctaagctatttatatgaaatttatcgttaaactttttcctgaaatcatgattaaaagcgaaactgtgcgtaaacgtttcgcaaaaattttaacctctaatatccgcaatattttacagaaatatgatgaagaaactgcagttgtacgtcactgggattacattgaagtgcggtcaaaaaatgaagagaatcgtgaagaattaatcgccttgttacaacgtattcctggtattcatcattttttagaagttgaagaaaaaccgtttaccgatttacatcatatttttgaattgacgcttgcggatgtcgcgcaacaacttcaaggcaaaaccttttgcgttcgagtaaaacgtaagggtaaacataaatttagttcgattgaagcagaacgttatatcggcggtggattaaatcaacatattgaaagcgcaaaagtgcggttaaaaaatccagatgtgactgttcgtattgatattgaagatgacaaaatgatgttagttaaaacacgtcacgctggtattggcggttatccgattggtacgcaagaagatgtgctttctttaatttcaggaggatttgattcaggcgtatcgagttatatgttgattcgtcgtggttcccgagttcattattgtttctttaatcttggcggtgcagcccatgaaattggcgttaaacaaatggcttatcatatttggcaacgctatagtgcttcacataaagtacgctttattacgattaactttgagggagttgtcggtgagattttagagaaagtcgataacggacaaatgggcgttgtattaaaacggatgatggtgcgagccgcaagtaaagtcgctcaacgtttcaatattgaagcgattgtgacaggggaggcattaggacaagtttctagccaaactttaaccaatttacgcttgattgatgaagccgctgatgccttagtattacgcccgttaattacgcacgataaagaacaaattatcgcgatggcgaaagaaattggtactgacgatattgcaaaatctatgcctgaattttgtggcgtgatttcaaaaaatcctacgatcaaagcggttcgtgaaaagattctagaagaagaagggcattttaatttcgagattcttgaaagttcggtgcaaaatgcgaaatatttagatattcgccagattgcagaagaaacagaaaaagaagtcgtggaagtcgaggcaatttctgtattaggtgaaaatgaagtgattttggatattcgtagcccagaagaaacggatgaaaagccatttgaatcaggtacacatgacgtcattcaaatgccgttctacaaactttcttctcaatttggtagccttgatcaaagtaaaaattacgtgttgtattgtgaacgtggtgtgatgagtaaattacaagccttatatttgaaagaaaatggtttttcaaatgtgcgtgtatttgcaaaaaacattcattaattaggatataaaatatgcgtaatcaaactaaacagcatcttgaacagcttcaaattaccatgcagcagcttaatttatggcaaacgatgccccctgctgcagaggcgtttttaagtgaagaacctttttcaattgatacgatgtctgccgaagagtggctacagtgggtatttattccacgcatgcaggcattattagaaagtggttcagccttgccacataaaattgctatttctccttatattgaagaagcaatgaaggaatttgatgagttacaacaactattaactcctttagttgctttagaagaacttctgaacaataaccaatgctagaaattttatatcaagatgagtttctcgttgcggtgaataagcctgatggtatgttggttcatcgcagttggttagatcctcacgaaactcaatttgtgatgcaaactttacgagatcagattggtcagcacgtatttcctattcatcgtttagatcgaccgacatctggcgtgttgttatttgcattgagcagtgaaattgcgaatttaatgtgtgaacagtttgaacaaaagtgcgttcagaaatcttatttggctgtagtgcgagggtatctacagggaaaagagcggatagattatccactaaaaattcaattggataaaatcgcagataaattttctcaagaagataaagagcctcaagaagcagtgactgattatgaaggattaaaaatagtcgaaatgccttatcctgctgggcgttatcaaacggcacgttattctttagttaaattaatccctcatacaggtagaaaacaccaattacgtcgccatatgaaacatatttttcatccgattttaggggatacgcaatatggtgacttacatcaaaatcgtgcattaatgtcacatttaggttgttctcgattatttttacattctaatagtttgtcttttattcatccaataacgaaagagcaaataacaattacagcaggtttagatgaacaatggcatcaattaataaatcaatttgggtgggaaaatgtttgatattaacttaacacacgaacagcaacaaaaagcagttgagcaaattcaagaacttatggcaaaaggaattagtagtggagaagcgattcaaatagtggcgaaagcactacgagaaattcataaaaatgataaaaaaactccagataattaaattttttgtgatctacttatcatttttgaatattgctcgttgcataaccgttcaaaatatttaaacataacggacctaattagtaggtgataaggcgagagtcttgttgatttattgttttaataggctaagcctagagaggtcttttatggaaattggtattgtaaaatggttcaataatgcaaaaggatttggtttcatttccgcagaaggtgtagatgccgatatttttgcacattattcagtgattgaaatggacggctatcgttcattaaaagcaggtcaaaaagtacaatttgaagttctccacagcgataaaggatctcacgccacaaaaataatcccaattgcggatactcaagaataataaataccctaaatttttttctattaatcctaacttaaaagacaagaattaaagttagaaagtcagtaaaggactaagcttagtccttttagttcgtattaaataagaaatccgcctttaaatttataagtccatcacttattcatcaacaatatcagtaaattctgcacctaatacttttgctaaatcttgtggcgcaatttctacgcttagcccacgttttccgcctgaaacataaatcgtttcaaactcaagtgcggttgaatttatcacggttttcacgcgtttcttttgacctagcgggctaattcctcctacaagataacctgtacttttttgtgctgcatctttatccgccatttccacttttttcacaccgatagattttgctgctttctttaaattcagcatattggccgttgcaagcacaaaacaagcgagttttttctgatcgccattttccgccacaagtaaggttttaaaagagcggttaggatcaatgcctaatttttcggctgcctcatcaccaaaatgttgattattcggatcatgatcataagtgtgcaagataaaaggaattttttgttttttaagtaaatcaattgcgggtgtcattatttcgttcctggttttggtgtaaaataatgctgattattttacagcggagagaaaaatggacgcaaccttaaatattgcgatagcagcagaatttgaattaagtgaaaaaattgtagagcgtttagaacaaagtacgcttgaaattagcaaagtttctattgttgaaataataccttttgaagaagaacaaaatattcgttttcgcaataaaggcgttgaacaacttgcgccaaatgaagtagagtgggctgattttaattatgtcttttttgcaggaaaacttgagcaagttgcccatattgcgcaagcagcagagcagggctgtattgtcattgatatgttaggcgtttgtagtgcgctttcggatgtgcctgttgttgttccaacggtaaatgaatcacaattacttgaattaagacaacgtaacattgttagcttgcctgatcctcaagtaagccaacttgctttaacgcttgccccgattttacaagaaacgaatctcaatcaagtatttgtcacctctttattgccgacttcttatacggatgcggaaaccgtgacgaaacttgcgggacaaacagcccgtttattaaatggtattccattagacgaagaagaaactcgcttagcctttgatgtttatccgcatcaagcacctaatttatcgaatcaattacaacgaatttttccgcaattagatcgtgctacattccactcaatccaagtgcctgtattttatggattggcacaaaaagtcaccgcactttcagattatgatttcgactatcagcctcaaaatagcgagcttgtcgctttagaagaaaccttaattacgcctgtgcttaatggagaacaagaaaatggcgaagaatcagtaaaacttcatttaagtcaaataagtgcggtagaaaatggcgtagaattttggtctgtggcagatgaacaacgctttaatctcgctttactttcagtgaaattgttggaaggaatttatcagcaaggttattaatgaaattaaggagaatagtatgcaaaatattctatttataatccattcagccccttatggtggatggaagctgacaaagtattaaatttttaattttctcgatagctaaaagaaacccgccacaagtgcgggttcttttttgcttattttgttgcagctttcatcgtttgaacaaattcagctaattcagctaaacattgctcgtgattatctaaatttcgctcaataatttttactgttgccgaacctgaaattgcaccagccgctcccaaagctaaggcttctttaacttgtgcaggctgtgcaatgccgaagccttgtaaaattggcggggcatagtgggctttaagttgttctacaagggtatctaaatttgctgcgtgagcttgattttcagcactggttacgcctgcacgtgagactaaataggtatagccttcgctatttttcgctacgccttgaattgttttctcatccgcatttggcgggcaaataaagacgggttgaatgccgtgttttttggccgcttgtacataatcttcttttgcgagtaacggaatatctgctacaagcacagcatcaacaccaacttctgcacagcgttgataaaaagcatctaaacctttagcaaaaattaaattggcacaaagtaataagctaatcggaatctcgggatattttgaccgcactttttccaatagtttaaagctatcttcactgctatgacctgcagttaaagcacgattattcgcggcttgaataactgggccatcgagtagcggatcggaaaaaggaaaaccgagttctaaagcatctgcaccgttatccacaagtgtgcaaatgatctcaaaagagcagtcgaaagtagggtcgcaaagggtaacgaacggcacgaaagccccttcattttttgcgttaagtgtcgcaaattgcgtttcaaaacggctcattagttcgttcctccatttaaaattttatcaacagtaaaaatatctttatcgcctcgtcctgaaagattaaccactaaaagttgttctttttcaggattttgtttaatcaatttcaaggcataagccaaggcgtgtgagctttctaatgcaggaataatgccttcgtgttttgccaattcttggaatgcgttaagggcttcttcatcggtaatcgatacataatcagcacgaccaatctcatttaaataagcatgttgcggcccgacagaagggaagtctaacccagctgaaacagagtaagattcctctacttgaccatcttcggtttgcattaaaggggatttcatcccgaaataaatgcccacttttgcatgacctaatggtgcgccatgttcaccgctttcaatgcctttccctgcaggttcaacaccaattaaacgcacatttggttcatcaataaaatcagtaaacataccaattgcgttagaaccaccgccaaccgcagcaatcacagcatcaggtaaacgaccttctcgttctagaatttgacgtttggtttcttcgccaatcattttttgaaattctctcacaatcgtcgggaaggggtgagggcctgccgccgttccaagtaaataatgggtggtttcatagtttgctgaccaatcacgcatcgcttcacaacaggcatcttttaaagaacaagagcctttttctacaggaattacttcagcccccattaaacgcatacggaacacgtttggtgattgacgctcaacatcttttgcacccatataaacacgacacggcatatctaacatagcacaagctagggcggttgccacgccgtgttgccctgcacctgtttcggcaataatacgcgttttgcccatacgtttagccaataaaatttgccctaacacttggtttgttttgtgtgcaccaccgtgtaataaatcttcacgtttaagataaagtttagtttttgtgcatttggttaagttacgacaaagagtaagtgcggtcggtctgcccgcataatttttgagtaaatcagcaaattctgcttggaatgtaggatcattttgagcctccacaaaggcttgttctaattgcttcaaaacaggcactaaaatttcgggtacatacattccgccaaattcgccaaaataagggttaagaagtgtgtctgacatattttttcctattattttatttttcttttgaaacgctcattcctgcaaaagattgagcggttggcattacttcaatacgattaatgtttacgtgttcaggttgttgatgaagccataatacaatgttcgcaatatcttcaggctgaaccgattgcacgttttcatagacttttgcggctctttcatcatcgccgtgaaaacgcacattagagaactccgtaccgccacataaacccggttcaacattgcttactcgaatttttgtgcctgccagatcggctcgtaaatttaagctaaattgtgtgacaaaagctttagttccaccatatacattactgcccgcataaggataagtacctgcaattgaactcaaattgataatctgcccgtgattacgagcgaccatatttggcaacacaaggcgagtgatagtaaccaatcctttgatgttggtatcgatcatctgataccaatcttgtaaatccgctttatgtgctggctctaatcccaaggctaaacctgcattattcactaataaatcgaccgcttgccaaccttcaggaagggtatttagagcgttaattgtgacttgttcatcacgaatatcaaaggcaagcggtagaaaattattgcccaattgtgaatggatttctgccaatcgatctgcacgtctacccgtgccaatcactttatagcctgcttcgatcaattttttacagatcgctaagccaaagcctgcggttgcacctgttactaatgcagttgtggttctcattttttctcctaaatcttgagcttatttgtactattaaagtagtacaaataagttttgattgcaagcaatttcattttaattttaaaaatgtcattaaatgaattaatttaacaatatcgcaaacttttgcttgatggtataatctgcccaatttttatttcaactgattgaggttaatcgtgagcaacacacaactgagctataaagatgctggcgtcgatattcacactggaaatgaattagtcgaacgtatcaaaggcgatgtaaaacgcactcgccgctctgaagttatgggcggattgggtggtttcggcgcattatgtgctttacccaccaaatataaagagccaattttagtttctggcacagatggcgttggcacaaaattacgtcttgcgattgacttgaaaaaacacgataccattggtcaggatttagtggcaatgtgtgtgaatgacttaatcgtacaaggtgcagaaccgcttttcttcttagattactatgctacagggaaattagacgttgatgtggcagcaagtgtgatcaaaggtattgcagatggttgtgaaatgtctggctgtgcgttagtgggtggcgaaaccaccgaaatgccaggaatgtatcacgaaggcgactatgatttggcgggtttctgcgtaggcgtggtagaaaaatcagagattattgacggcacagcagtgaaaacaggcgacacgcttatcgcactcggctcaagcggtgcacactcaaacggttattcgttaattcgcaaagtgcttgaagtaagtggtgcaaatccagcggatttattagaaggtaaaccacttagcgaacactttttagcaccaaccaaaatctatgtaaaatcgattttacagttgatcaagcagaccgaagttcacgccattgctcacttaacaggtggtggtttctgggaaaatatcccgcgtgtattacctgcaaacacaaaagcagtgattgatgaatcaagctggcaatggcctgcgatcttcaactggttacaagaaaaaggcaacatcagtcgttatgaaatgtatcgcacctttaactgtggcgtaggtatggtaatttcattaccagaaaaagaggttgaaaccgctcttgcattgcttgaacaagcgggcgaaaaagcgtgggttatcggcaaaattgaacatcttggcgaaggcgaagcacaggttgagattcaataataaaatcttaaatttaaattcagcccttttgggctgatttctataaggaagaaaatgaaaaaaattgccgtccttatttctggtcaaggaacaaatttacaaactattattgatgcctgccatttaggcgatattcccgccaaaattgcttgtgtggtaagtaacaaagctgatgcttacggcttagttcgagccaaacaagcacagattccgcaagcggtctttcttcgcaaaaatttttccaataacctcgaaatggacgacgccattggcgattatttgcaaagcctagccgtagatttgatcgtccttgctggttatatgaaaattcttaccccaaaatttacccaacgttttgcagggaaaattttaaatatccatccttctcttcttcctaaatacgcaggcttaaacacctaccaacgtgcgattgaagcaggcgacaatgaacacggtacaaccgttcattttgtcaatgaagaagtagatggtggtgcgattgtcttacaggcgaaagtgccaatcttccctgaagatagcatcgaagaagtggaggctaaaacccgtgagcaagaatatcaaatttatccgcttgtgattaaatggtttaccgaagggcgattaagacttaaagataatttggcatatctagatgggaaagctctgccaaaatctggatatgcaaatgaataacttagaatttagacagactatttctgtattttttatttaattaggatgtaaaagtgcggtgaaattttaccgcacttttaaaattagtgatgatggtgttctggttttggaggtagtttagctaatcctttaccaaccggtaaaattaatgtgctatagcttgcagattgctgacaaatttgttgatctgcaaatggtgttttatgaataactttaattttccaaataccatcaattaatggaatgatattcacacgtccttgactatctgttttacctgaaaaaccttgtggttcacgatgacctgtacttgcttcaagatctttcacgataatagtatcagcggttgcgatgacagtttcgcctgctaatggctgatcttggtagaaaatttgaacagggaacggttcgcctgatttcgctttgctaggatcacgcaaaggaacaatttccagtggtaaaccaactcttgtcattgccatttctgcatttaatggttttttaccaacggtaacaagacttttgccaaacatttgagtttgttcacaataagtgggattttctaattctttcaaattatccattttccaaccttcagcattttgtgaccaaaaagtaggtttataagtcgctgttacccaataagaaccatcggacaatgctttctctgattgatattgatagttttcgcctttttggattaaggtttgtttttctccatcttgacgaataatttccattggtgcaaaaatttttaaacgtgcttcaggaattttttctacataagggtaatccccataagctaattctgcttttaatacagaaccagatgttaatttcgtcggtgcttgaacccaaacttcatgagcttgtgctgtgccagctaaaaccaataatcctgtaatcaatgtctttttcatatatttccttaataagaatggaggagttaaaaatgagtgtgaatactaaatgaaaagagctatcatttaaatagctatttaaataaaattttaagatttgtgatcgagatcacaaaatgaaaaataccataagaaatagtataaaaataccctaaatacaaaatatttagggcgtcttataaattgaggaaaatgttttaatcgtcttttttagatggtttaatgcctaataaattacaacttaatttactaatcacatgttctgcagtattgcctaataatgcggcagataaacctgttcgtcccactgtgcctaaaatcactaattcagcttcaatttctttcgccacttcaggaataacttcctctgggaaaccttcgcgtacgtgagtatgatcttcatcaatcccaaacttctgacgtaacgctttcatattaatgagatgctgacctcgaataccgttttcataacctgaagtattaaattcaggtaaatcaatcgccatattgattggcgcggaagggtaggctgccaccaaatggacattaccacgatttagattttccgcgagtgaaatacctgtttctaccagctcttgattaaattcatcttgatattcttgttctccagaaacattcaccgccacaagaatacggcgttgatgtttccaatcgccatcacgaaccattaagacaggaatagggcatttacgaagaagttgccaatcaatgggagtaaagataagagacgtcagtttttcttcgtctttagtatattttacgactagatcgtaattattattttctacttcttcgttaattgcatcagcttcattgctattccacacaatatgagattgtaattcaatttctggatttgcatatttatctaagtaatattgaaccacatggcggtgtttttcaattacttgttgatgcatttctgaacgttcttcacaagaaagtaaagctgacatttcataagataaatcatacactgataaaagtgcggtgatttttaccttagtttcatttttttgttcttcaactaaacgcactgcacgagctagggcgtactgtttttcattactaggattaagtacaacgagaatatttttaaatttcataatagcctccaaaattgaggcataggataaaaaagaatagcaaaaatggcaaggtacaagattaatttggataaatttatttttatcaagcacaaaaaggcgtgatattcacgccttaaatttatttaactaatgtaatttttgttttattcgtaccagttaattcaattaaaccatttaaatcattgattgtaatatatttgccttgtacgctaatcacgccgagtttttgaaagcggcctaataagcggctgatggtttctactgttaaacctagataattaccaatatcgccacgtgtcattgttaaacgaaattctcttgctgaaaaacctcgagcagaatagcgtttagaaagattatgaataaaagcagccaaacgttcttctgcattcattttagatagcaataaaatcatctcttgatcacttttaatttcactgctcatcaaacgtaaaatttgctggcgtagttttggcatttttcctgccaaatcatctaaaatatcaaaaggaatttcacataccatagccgtttctagagcttgtgcaaaactagggtgttgcatttgagtaatggcatcaaaaccaactaggtcaccgggcaaatgaaatgaagtaatttgttcttcgccagattcactaatcgtatagctttttattgtgccagaacgaatagcataaattgaattgagagaatctcctgctttaaacaatacttgagacttttgaatcggtttttttctctctatgatattatcaagctgatctaattcttgttcatttaaggtaaaaggaatacaaagctgactaatactgcaatcctgacaatgaatcgcacaaccgcctgattgaattttgcgccctgattgagctcctgcaacgaaatttttcatgtacgtctcaaatattgaaaaaaatagtgtaaaattgatctaacgcaaatattctaccactaattagtcagattaagaagagtaaagcattatggcagctgaaaaattaacaaaaaaacgtttagctcaaattttaattatgttgtgcattttaattattgcatttgtttggcgatatttttagaaaacagaaaattcttgcttatttttaaaacaaatggattatttccaataaattttgcttgtcacattcttatatatacgtataattcaaccccattaagcctgggtggcgaaattggtagacgcagcggattcaaaatccgccgttgaataaacgtgtcggttcgagtccgaccctaggcaccacatacaaacccttgatcgttggtcaggggtttttcttttatgcatttcaaccagtaaaatcaataagttacgttcatatccgctataaattcatcaccaatcccaacctcaaatattgccatttttaagtatttttatgcatcgattacgccaaaattacgccaatgcaacatgaaatggggtgcggaagaggaaaagaaaatagaattgcaagcgcaaggattgcaacctgatacattattttctatttgaacgaaattacgccaacaaagcgtggagaaaagcacgaatttaatcggctgaatcgctttttacgccatccagttacggataaatatatatctgatgttagtcggataggggatgaggaattgtgttttgatattaagtctagtgtgcttgatgcaacattccgaaaactcaaaaaacttgccgagcgagaatatttgcattttcacgacacacggcgtgaggcattgactagactatctaaaaaagtagatgtgatgacattagccaaaatatctgggcataaagatatttcgattttacaaaatgtctattatgcccctgatatggcggaggtggcggaattactcgattagctaatatgtttagcattgatccgccccaacgaacaacttcgcctgcgatatagcgtgggcgagaattttgttgatcgactgtaacgggttttgggaaattaggcagttttgaaataatcttggcaacggtttgatagtgtcgcccaaaatatattgcgatatcctcaagcgtaattaaattttggcttttctcggtcaaattagataacgccgccatttttgccgcattcacaatttcttcttcggctttctgcgaaagtttaattggttccatatttcctccaataaaaaaccgcccataagagcggtggtttgttaatattgttgtgtctgttcggcatgacagattttgccgtcacagtcttgattaagatttagggcgtgcgccatatacaccacaaatgcacacacgagcgtaatgattaatttgttcattttctgttcattttgtcggattttaggtgtgagaatccgccgcaggcttaaaaaagtgcggtcggattttgtgatgttttattgggcaatgaggtttttcgctctttcccaattcatttgattagacgctttaaatggtgcaattaatttctgagttctttgcccatatcgagggtaatgtgatattccttgcgtgggcgtccgttggtgcgttcggtgatgacgaggtagtcttcattttggatgaagccatattcgttgatgcggtttttgatccaatcagtgtattgctgtttgctttctacgaatgcgtgaagttcacgagcgttgcaaagttgaacgggttgattttggattaagccattaaaaacaggaattaagtttaagtgtgtcattgtgatgtactctaagttaagttttaaaactcatcacgaaccactgcgaatagttggtgatgaactgaataggattcgcagtaccgtacttagagcaaaacggcggatctttcgatcctcctaaacagttcatcattgggctttttcataaatttatgaaaaaggtagaatagctgttttgtggcgataaaaaaagacgcattgagcgtctgtctttccaccgctccaagttattcagaaactgcgacattcccgactttctgttgaaagtgtggttatcttaatccgaagtgagggcggtgtcaaataaaaagcgctgagaatttgagggagcgagttattcatcatcaattaattcttttgttttctttggaatgtcattcacctctcctttaataccatcaacagctttatccaggcgttttcctactccatcgataattgtttcaagtggtgtgctttttaaatctttgtcaaagactttggttggatttatccccaaattatccacggcaatttgcagaagttgctgatgtaatttagggtcttgttcttgtacttgtttcttataaccttcaaatgccattgctgaggaatatttgtagttataatcctcccttaatctaaagagataagcccgttcttttgcttttaaccaggcgatgacaagtaacgggattgtcacaatggacttagcaagaaattgtaaaatattaaggctgtctgctgcactcaggcttgttgaataattgaacaatgaaataacagatgttgcaacaagtgacccaagcaaaattttatctacagctttcattttactatcgatattttcagattgagttttaaacgaacctgccatgcttgctcggttggcgtcttcaataatcatttcaatctcctctttttgtttattgaataatttaatcataccttcaatatcttcatgatatttttcgatttggggtttattggtttccgctgtggttgctaatgtcgtaattttagtaagattattttgtgcggtgaattcatagttcgaaatgtcgccacttaatttctctgactgttcgtgccactgggaaatttcagttatttgttcttgtgcgtcgttataagattttttgagtgtaatcagtgagttttttaaattttcgaactcctttttattctctactaattgctcttcaagtgagatgtgctcttctaaattcaattttgctttggatatatctgcagcaatagcattgagttcttcttctgttcttaattcacccttaacttcaattaaatataattccttgattgtcattcttagtttgattagagataaaataaatgaatttacatcatattcatcccatttattactcgctctttttttattgaggatgcgaattatttttttaattaattgaagagaaatatattttgcataggaaatttcaagactttttccagatttttctattttctctattaagggataaagttgctctatttctttgataatttcgggtgattttatttcgcccatccactcatagtcttcgttgatttttgtattaattaagttttttaactcagtcagtcttgctttaacggttttcatagcattccctttatatattaaaaattattctgattgtaaggtaatttttcgggataaaaaagccctcgttttacagagggaaaaactaaggaaccgcataagttttaagccctcatgctcggctaacttcgtttgtctgccatttcaaagcgcactctgtcttgcatttgtgtttctgtgcgcttggattcactctctgctgagtacgctttgaaatttaccgtctttccggtatgtcacgcctttagctaacgtttgctgtctgtcgctttcccatttttaaccaacttgaaaacagaccaaaaggtgtggttcggtttacctgtctgtttccactttcggcaactgcaccgtttttcacaggcttccacttggacagatattcaaaacacagtgttgctaagtaggttagggctttcaatctaacgaccgcctagcaccgttatgcactgtgattctgtagccaaattgtctaaaactcaaaacaggttaatgatgagtgcctttctttatacttgtaaggctcaagtccttattgtcaccacaacacataaggaatataatttccctcaaccacaacacaaaaaataaggaagcatcatgaaaaaaatagcagcagataaaatagctcttgttatggcaagagatattttaaaaacaaactctcaatatttgcgagaagttaatgagtatgtggccgaagatattgccagatttgtttcaacattatcatcaagattgcaagaatctattgatgatagcatttccagttcagatatttttaacgcccataagaatcaataaacatcactgccgaacatacactctcagctaattcacttggtgttaaatttgtatttttatcagcactttctaatacagcctgtttgattagatttttatctttatcagataggcttttttcttgtttttcttccatatttgaacctcgtttgttttatgtctgccatttcaaaacacacttcatctatcattcgcaacggtttcacatgccgttgtgtctctgtactagcaaatgtgttttgaaatatccacattgggatattcgcctgcttgagctccactttcggcaactgcaccgtttttcattggctttgcatgggcagactttaaaactcactcttaactaagtaggttagggctttcaatctaacgaccgcttagcaccgttgggcttccgtctgcgcttccgccgagtgagtttctttaaccaaattgtttaaaatttgtgatgaaagtcactgacttacataaactttttagctattcttgtaatcaaccttgatactttcgatagcggattttcaggaatgtaaactgaaaggtgaatctcgccgtcaacagtaccttgggacattgcttttagcttttcttccgcttcttcgaatgaatgggcgtaaacatctgtcgcccaccttttgccgtcgaagtgataagaaattgcatagcgtttcatttcttcttgcataaggaactacctctatgtattttcagatatttcagggtgtaaacaatcagtggtattggcgactaaaagccgccaatcatgaaaccattgcagttagcgagggttatacaaccaaacaaaactgcctacattgcattgatactactcctggacactgatataagaaaaacccgctgaagaattttcacatgcaagccaagttaccaggattgtgatcgcatgcaaatttttcaacaacattgcgataatcatctctagattttatgtctgtgattctacgtaaactacatttatttgcaactattgtcttttcaaaactggtcggatcctcaactacagctcaaagaacgtatatggaaaaagaaaagaattttgagaaaagttgtttgattgcctgttttttaggcaaattaggtgagggaggtgaaaagttcggtcgatttttgaggtgtttcggtgagttttaggaaaaagaaaaccgccacgaaggcggtttaggtgtcatataaatttaggagtaaagaaagtctttagtgcatctaacttataaattagtccacgcattgcagtgttccttacctcaagattatctgatacaagatgatctgtaattgcttggtttacttctcttaactccattctagggtaacgttctgaatttgataggcttttaatttccagacattttgattgcaatcttttatgaaatgcaatcataaaggtggtaatccatttcatcacttaaattgattgtgtctttttgtggatatttaacgcttctgtaaaaacagatcgcacaaatcagataattttgagagctctccattataagctgtattttttaaaccccttgcgcctaatatatagcttataggtaacgcaaagatagaaactataagcgcggagaaagctattagatcagaaagagtcatttattatccttcaaagataaaatctcaatctctttttctacataacttttaatttcgtcaataatatcatggtcgtcatttgaaataaggtttttaacaagatttaaaacaacctctggagaaataccttttctaattgctcctccaaaagtttcttcaagaaatgaagagccatatccttctgtgtcatctaaattaagaatgatatcaggatccctttttattgctgggataagaatagaatctctaaattcctctccactagctttaccatctttaatgtaacgtggacctggatattggctgaaatcttttacataaatagtttgcattattattccttaatttcttgtagcggaatgttccactgaacaacagtaccattaatagagtatctagattctttggttaaatctggcttatctttgccattatacacatacattcctcgatttgaacgaattattagcctgcttcctggtgttttgtcaataaatgctcgaatatcacttcccccttttcctctatgtcccaatcctgttcgggtttctttaatgagggtagaggcttttatatataaacaatcttttgtcggtttccccagctgctttagtctattccaaatagcagaaagtacatttgctttctgtgttttttctagggtattagggatcccgtgacccaaatcacaaacaaaaagtgacaattttccttctaggatagcaagcaacatccaccaacgttttataggaaattctcgttcactataaatattttgggcgtaagcatgttctaccgcatttgcaatcgcttcaatgtaactaggatatatccctttcacccccatacttttaagttcatctaatagtggctttgtgatttcgccatctgcactatcactataaacataatgccaacatttcacattttcttgagaagatgaagatgtataattaaaccctaaggatttatatagtcctatatgacaaaatatagcatcaacatcatagggaatatgtttacgatgatctgctggttttgattttggtcttacaatttgaaatttcaaggttctatattgcgattttatcgtatctaaaacagctattaaaacgctacaagcggcagcatcgataatatcagtgtcccgaaaatttagtttcaggcgacttcgacttcgtgctgctagttttgctttttcttcgagctcttctttaaatgctacaaattcataccctatttctttagctaaaataattttatatggggcgataacctcaaaaagattaaaggatttatgagcaagatgtttatatttaggctttccgcctctttgtctgattttcttttctttacttgtgagagctcgtaatgttctttgtctaacaatagatctccataatcgaatatccatagttggttccttgggtaacttatgtagaagtcgttttagttattatgttttctataataatactgaataccaaaacactttccctaacacagaaatatcttgtagttctgctatttcatcagggtgttcttcggtgttataactgcggattttcacttgttcgtttggcatattgtaaagtagctttatgcgtagtagcccaccgtgatttattgcgtatattttcccatctcggattgttttattaccaagatcaatgccaactgttgttccatccggaataacaggctccatcgagtttccgtcagcaatcacacataccgcattttcgtactgtacgccttgtttacgtagtgttgatttggaaaaacgcaatttgaagttgttatagtccgctatgtcatcagcaaatccgtttccagcagcaaggcgaatgtcttgataaaacggaacggcgtattcatcgctatttagtggagtattgcgatcccataagtcgaatgagccaacgtctttcacattagaagttacttgattttctaaagaatcgactgttccgtatttcaaatgagcaggggtaactccaaagtacttcgctatagcttcaattttattatctctcggggttgcagtgcctaaagtgtaacgtctagccatttcataggttacgccaacagctttttgtaaatccacaatatttttgccttgtttagccattaattcattaagtcggcttgctaaatctgtcatagacactcctttattctactaaaggtagaagatacaaaattaaaatggttgattcaattctatttttaatagtagaattatactactttaaatagaataaagaggttaaaatgctaccaatcgaaaaagcttatgaaatcgtgggcggtatttcggctatggctcgacatttcaatcttaccccttgggctgtttccaagtggcgtgaaaaagtacctgcggaacgttgcgcaaagattgaagaacttacagatggaaaagtcaagaaatccgaattacgtcctgatttgtgggattaatttaccaacctttaccaaaaagaaaaccataaaaataaggcaaaaattatggaaatgaagaaagttattatcgaaatggttgatcggattcctggggggagaagtgcggtagctggattcctaggttttaccgaaagtgaattaaagaatcgtctttatcaaacaaagggtcagcgattcaaaaatgaagaattaattgcgattcagcaagaatatggctgcacgcaatttattgatgaactatgccgtttggctggtgggcgttttgtacctgatgtagcagagaatgaattagacaaggttgagcttgctaatttacaactgcacgagctttccgcacgaggcttgttatttgctgcattagaaacagcgttagaagacggcgaaatcacttcgaaagaagaagacaaaatacgtcaagcattgagtaaacatttggcagcgacgcaacattcgattgaatgtgcgattgtgttacacaagaaataaaaaaagccacgaggagatttcgtggctaattcattaaggaatatacagatgaatcaattattaacgatttcgaaagaaaacacaagcactttgacgatgagtagtcgtgaaattgcggaattaatcaataaaaaccacagcgatctgtgtcgttcaatcgaaagacttatcgcaaaagaggtgatttgggggtatcagccaatggcttacacccatccacagaacggtcagacttattatgagtaccatctaaccaaacgagatagtttaattgttgttgctcagaattgtcctgaatttactgcggcaattgtcgatcgctggcaagcgttggaaaatcaacaaaaaccaaccgcacttattccgcaatctttttctgaggcgttgatgttagccgctcagttacaagcagaaaaagagcgtaatgcgcctaaagtcgcttttgttgatcactatgtggaagtagggacgagtaaatcatttcgtgagacggcgaagattttaaaaatgcctgagcgtgcattagtcaatcgcttggtggaagataaatatttgtatcgtcaatctggcgtgcttttgccttatcaatcggcacgcaccaaagatctttttacggttaaaacaggtaccgctgaacacggtcacaattacacacagacacgtgtaacaagcaaaggcattgaatttattgcgtcacgttatgcttcggagttgatgttatgagtatgcgattaatggttcaagcaatgaattgtaaggttggtaatcctgctagaaaacttgtgcttttaaaactggctgataatgccaatgatgatggaatttgtttcccaagttatcaatacattgccgataaatgcgagatgacccgacgtagtgcaatcaatcacattgaatatttaatcaaaatgggattagtaagcaaaaaagaacgtaaaaataaagatggttccatctcaaatttatactttttacaccttgaacaaggtagtgaaaattttgcactgggtagtgaaaatatttcactaggtagtgaaaattttgcactagggggtagtgaaaatatttcacccagaaccagtcactctttagaaccagtcaatgaacctaaaaaaactacgcaaaaaagcgaagccgaaatgttgcttgagcagttcggtattaccggacaactggcgaaagattttatcgcacaccgcaaagccaaaaagggcgtcattaatcaaacgcaactcaaccgtctgcaaaaacaggcggacaaggctgggatttcgatttgtgaagcggtggaaatttgcatcgaacgcaactggcagggatttaacgcatcgtgggattggcgtgatgaaaaactgcgaccaaattcaccgcacttagggcaatcacaccgcaacaaacccaaatttgacgatacgcagacaggctggtctgcaggaatgaatttcatagtggacggtacacaatggcaaattccataacacaaaaccaaattaacacgctcccaccagaacgcacacagcgtgcggaagagacgattaactggctctttcaagagcttaaatcgatttttcctggttggcgtgcagcctttgaaaccggagcggattatctctctgctaaaaaaacttggttgcgtgtgttggtacgagaaaaaattacgagacctcagttggagaatgggatttgtgaagcggaaaaatcgcttgataaatttttacctagcgtagggttgtttgtttattggtgcaaagcctacgactatcacgcactaggtttaccgaacgaagcggaattataccaacgttataacactttcttaggctatgcccgattcaatcgggatgaatttcaatatcgttcaaaagtggaattttggttgcttaaaaatctgtacgaaaagtgcaagaaaaaatcggaagaggacacgttgaaagctattccgaaattactcacaaaagcggcagaaaaagtgcggtcgaattttccttttgaggatattccgaaaatgattcctgaaaagccaagtttttacgataaagcgaaggctgataaggcgcgcgatagcttgatggcaatgatgaaagggaaaggggcattgcaatgacaagctataaatgcccaaagtgcggtgcggaattagaggatttttatacgccagattattttatatcgagcagcgaatgggatgacgatcgttttcgctgtaacggtcacttaattgagccgataccgtttccgcaggtaagtaaatacagtgcagtgaatcgaacaaaatcttgcggttattttgggttggaagatttaggtgtggagtacaaagaatgagttttgcgatgttattcaagcgctgggaatgatgtgatgagccaatataaacctttctttttacgcgatcaacgcattaaaaataattgcttggatttaatcaaagagctgccaatagacgataaaaagccattggtagtcaaaatccaaccaataacacgctcacttgagcagaactcaaaacttcacgcactactaagcgatattagcaaacagtgcgaatttaacggtaaaaagcgagacattgacacgtggaaaatgattatggtatcggctcacaaaattgcaacaggcggtcaggctgaaatggtaatcgggcttgagggggaagttatcaatctacgagaaagcaccgctcaaatgagcgtaaaacgactagcaagcctaatagagtacattaccagttggggcgtgcaaaatggcgtgagatttaacgatagatgggggttttaaatgaaacgcttaaacgatgatgagattttggagttaaaaattgtacttttgattgcggcagtttgggtaatgtttaatatggtgtttggctaatggcgaaagagtataaatgcaaagtttgtggcaaagcgtttgtaaaaacctttagctcaacacaaaaagtttgctcgcctgaatgtgcgattaaattagtccgagaacaatcaagaaaaaggcaaaagaaagcggaaaaacaagaacagatagagcgtaaaaaaagattactagatggtgagagggcattggctaaaagctcttcaaaaagaggtaaataaatttataagattgagagataaaggacaaccttgtattgcttgtggaacggtatggaaacctagttttcaagcgtctcattttattccgcagggaagaagctcatttttaagatttgatgagaggaatatccattctggctgtatcagatgcaatcttttcgtaggtggcggaaatatacatggatatagaccaagactagtcgagaagattggcgagcaagaggttgagtggttggaagaaaatcaacatcgaattaaaaaatgggaaatttctgagcttaaagaaatgctaaaactatacagattgaagaacaaggaattagaaaatgaaatgcaagattgatggttgcaacagagaggctatgtataaagctgattgcgtttgccaaatgcactattttagatttatgagaaacggaacttatgatcttcttccgaaaccaatccgaaaatacagaagacacaatggaaagggttatcagttaattttcgaaccaagacaccaattagcaatgagcgatgggtatgtttatgagcatagatttgtgatttatagcatttatcaaaataatttacctaactgcaagctttgtggctgcaagctaacttggagcagttgtcacatcgatcatattgataatgacattaccaacaacacgctagaaaaccttagaccaatttgccgagcttgtaacgtaatgagaagtcacacattaatacctaaatatacacacaaaggtcattctaaaataacttttaatggattaacaatgacagcagctgagtgggctagacaagatggcgtaacagtagctgggaatacaatcttgagaagaattagagatgggtggagcatagaaagagcattatttgagacaagttcaacacatccaaatgcagcagttaagcacactactactaagtataaaaatagatttgaagtgaaatctactggaataagcttagatttaagattgcaaggcgatgattaagcattacaaggcaaaaattaaggagcttacgtgaatattgatgtgatttcagttgaatttggttattgggctacacctcgttatgagactgaatttccacgtgtagccgcagggtttgcagagatgaaatgtgatgctcgttatgctgaaaaatatcgtatgcgtcctataagcgatgaattaggcatggaaattgatggctaccttggtgtaattagaaaagtcacaccagaactttatgatgtattcgttctgacttatatcaagagatgggaaaaacaagaaatttggcgatatttacatatttcacggcgtgaatatttcaatcgattgaaaacggtaaaaacatcacttttattgctattatcaacagaaggcaagcaatgtttatttattgcctgaaaagtgcggtctattttgaccgcatttatttcaagggtaggtattctttctattcttgtccttcctgaagtgtgagtttggggtgtatcttatctaacatttcataaaaattatctttatctttagatagctttaaaagtgtaacgatagaagataaatgttcacgcaatttagggtgccctacgtcttccgttaaaaactggtgtaattttactttttttgcttgtttacttgccgattttttgagttctggtaataactctggagcgagtcgggcatacacggcgttgtttgtaatatgcccgaagaattgtggaaattgattattatttttcggagggaattgaacgccatataaacgacataattccttgtaatagtctaaaggaaaggttttaacccaaggttgtaattcttttgcgacaaaggcttcaaaaatttttgcgagtgcgtctttggctcgtgcatcttgatagccggtgacttcatccactaatgccacaatgcccactttggctaaagagcggattagaatttctgctttttgggcggtgttttgttgcttaccaaccaacgccccttcttcacgtgctcgtagataaatatcacacacgacaggtaaaatagtcgcatcatatccttccttaattttaccgtctttggtgcgatatttaacccctttgatcacatctataacatcttgattaataaatggttttagattatttgcatccataaacgcagggagtttgatcaattcttcgttttctgttattgcgccaccacgagaaccacgatttgggcgatctaatgcttcaaaaacagaagcacttgaaataatgcgtaagtcattttgaagcactgccacatcaagcgatttatcaccaatgcttaatacgccttcgtgaatagctaaagggagttcttctagtgcttttttatgttcccagcgtgctaacgctgctttctcggctcgttctttacgtttttcagccgttaaggaggtagaaaccatatgttgctccattgcttatttataacttttattagcataatgctaaattatatttaagtaaagcattattttatgctttacattctcaaaattttcctctactattttattcaaggtctcaaaagccttatcaagaacggtaactcaccccgtcagcgtgatttttttatgcgtaaaatttaccttgtttgttttattgccattaagacttacaacgcataaaaagaaaattatcaatcaatgttcgacagtgcgactaatacaataccgaaagggaataagtccgctggattcttgaccagttttgagctgtcgaacgcccgatttatcgggggcttccatcaaaaggaaatcaagatgactactcaaatccaattctcaatatttaatttcaaaaattccccagttcgcacgattaccgatcctaatagtgaaatttggttctgtggcacagatgtgtgcgatattctcggttatgtaaatgcgcctgatgcaatgaaaaaacattgtaaagaagctggtatagcaaaacgctatatcagctatccaagcggtagaaaggaagcgatctttatcaatgaaccaaatctttaccgtctgatcatcaaatctcgtaaaccagaagctgaaccatttgaagcgtgggtatttgaagaagttcttccgcaaattcgtaaaacaggaaaatatcaacttcaaccgcaacagctcgccttgccagaacccgaaaagaaattcagttttgaatttaccgagtatgaacttcaacagcttgtttggttgtggttcgctttcatgcgtggcatcgtcacattccaacatatcgaaaaagcctttagagttttaggctcaaatatgagttcacaaatctacgggcaggcttacgagtatctaagcgtgctacgctctaccaatcaaatcttaaaccgcatcacaagtgattttgacatcgaccaaatgacaaactggcgtgtattaaaacacttgcgaggctttaatccaaaagcagtcaaaatcgacttctaaaaacaacggaaaatccgaccgcactttaccgtgtggcggatttttacacctcaaattcacgaaaaaggatacattatgttcagaattctctttgcggtggcgttgttatgggcagcatacgaactcaatttaaaccaagattgcgatgggtatatttgcgacacgtcatcactaattaccgcacttcataaaccgcttgacagtgcacactaaaagtgtatcatatgtactatattgcggttttagtgcatagcaaacgcaagaaagattttacagccctgatcggaaacggtcggggcttttttattgcctaaagaacaggcgggagaaaatatatgccaattaaagagcctgatgtgtgggcgttaatatggtcttggttgcaaacaaatcttagttctagctcagcacagagtgctttttgggcgttatttatttctcttttaagatttgggtttatgcgtaaaaagccagctattcgttatgttttaattgatgcggctatgtgtgcatccattgcgggtgttgcagtgccaatttgtacgcatttatttgggcatacagaatattcttcatttcttggcacgatgattggttttgttggtactgaaaaaattcgcgagtttttatttaaattcattaatcggagaattgaaaaagatgacaatgatgatttccgaagtgacatttaataaaatttttccacacgcagttaaaggtgtttatcaagctatttcggcgcagatagaaaaagcaggttgtgtgaataagatgcagcaagcgatgtttttggctcaatgtggacatgaaagtggcggatttacaagatttaaagaaaatttaaattattcttggcttgggctttctaaaactttccgtaaatatttcccagaccctcttatagcgaagaaatatgagcgcaaacctgaacttattgccaatcgtgtttatgctaatcgtctaggtaatggcgatgagaaaagtggagatggttggaagtatcgtggtcgtggactgattcagatcacaggtaaggataattatgccgcgtttagaaaatggttaggtagagatattgagccagatgatgtggcagggaatttagatttatctgttaaaactgcagtgtggtattggaaatgctatgagttggctgagcttaattctgtggaaaaagttacgcgaagaattaatggtggactaaatggcattgatgagcgttgcaagctctatcgagcattaatggtaacggataatgactaagtacatttacatggcgttagcgggtgttgtcgtggttttgattggtgcattgcgttaccaatctagcgttatagatgagttggaaataacgacaaaacaacaagaaaatactatccagcaacaagaagatgctaacaaatcattaagtcttgcgttacaacaagagcgttatgccattattgagcaacaagagcgtaataatgaaatagaaaggatagcaacagaaaatgctgaatcagttaaaacaatcattaagactcaaccttgtgctcacactcgtttgcctcagtctgttcttgaccgcttgcacgaataaaatcacgactaaaccagaatatatttatccgcctcaagcctatactgcaccttgtgtcaaaacagcatttactggggaaacatacggcgatgtagtcatacagttagttaaggtaaccgcagagcgagataagtgcgcaagccaagtagatcatcttaataagtggattaatcaagcaaaaggtggtaaatagattaaaaatctaattgagcggaattaatgccaagtgctgtcgctattttaatgcgagtgcttttacgcaaggtctgtgaattttcgtgttgtgaataagcagcttgagaaatgcctaaacggcttgccacttccgcttgtgttaaacctaagtgttcacgccaagcacgcaatgcagaataatcgttcaataaagctaatttggcaaccgcttctggaatacctgtctcaagtggattggtaaagatgattttttcataaaatgttaataaatggttcatctttctattttataagttttattcaagtattttaaggatttcctatgtcagacgtgaaaggaaaatctacgtctggtcgtggattaacacctaaacaagaaaaattttgccagctttatattgagctggggaatgccagtgaagcatatcggcagagttatgattgccaagatatgaagtccgaaagtataaaccgattggctaaaaaagaattagataagatcaagattagatcaagggttgatgtgcttcaacaagagcaccgacaacgccataatcttaccctagataatatcattgcggacttgcaagagtatcgtgatatttgtatgggaagaaagccacttactattaccactgtggtaaaaaatgctcaagaaggaacggcacaaagcgttaataccgaatgtttcgtttttgaaccgacaggtgcaaataaagcccttgaattgcttgggaagcatttagggatgtttaccaataaagttgatgtaacaactgatggcaagcccttacctactgtgattaatgtgacatttagcgatgagccagcttaatattcaatttcctacgaaattccgaccgctctttgaatctatttggccgtttattattttctacggtgggcgaggttcaggtaaaagttttagtatcgctagagcattagtattgcgagcctatcaatcgcctgttcgagttttgtgttgccgtgagatccaaaaatccatttctgattcggttattcagatgttggcagatcagattgaaatgttaggtctacaaaatttcttcgatgttcagaaaacgcaaattatcgggcaaaacggttcacgcttcacgtttgctgggctgaaaaccaacatcacatcaatcaagtcaatgacgggcattgatgtagtttgggtagaagaaggcgagaatgtttcaaaagaaagttgggatatattgattccaaccattcgtgaagacggttcgcagattattgtgagctttaacccgaagaatattcttgatgatacctatcagcgttttgtgattcatccgcctgagcggtgtaaatcggtcttagtgaattggcaagacaacccatattttccgaaagaattaatggaagatatggagcagatgcgtgagcgtgattatgaactttatcgtcacgtttatgagggcgagcctgtggctgattccgatttagccattattaagcctgtatggattgaatgtgcggtggatgcgcatctcaagctcggttttaccgctaaaggaatgaagaaagttggctttgatgtggctgatgagggtgcggatagtaacgataatgcatttgttcacggttctgtggtgcttgacattgaagtttggaagaatggcgatgtgattgattccgccaaccgaacaaatcaaagtgcggtcaaatttaaagctgatttgattatattcgatagtattggcgtgggggcgggagtaaaagctcactttaaacgcttgccaaaatctttacaagtggaaggatttaatgctggtggtgcagttgcttatcccgagcgtgaatatatcaaaggaaaaaagaatcaagatatgttttcgaacattaaagcccaatcttggtgggcgttgcgagatagattctataaaacctatcgagcagtaaagcatggggatgtttaccctgacgatgaactgataagcctatcgagcaatatcaaagagcttgagtatttgaaagcagaattatcacgtcctcgtgttgattatgacaataacgggcgggtaaaggttgaaagcaaaaaggatatgaaaaaacgtggcataccttctccaaatatggcggatgctttagtcatgtgctacgccacgacaaaacctaaatcactactggatttataagatgaatattttagatggcatcaaatcacttgcgttaaagttaggcagcaaacaagaccagacatattatgctcgtgggcttagcttaaccgatgacttaatgcaaatcgaagcattatggcgtgataactggattgcaaataaggtttgtattaaacgttcggaagatatggtgcgtaattggcgcgatattttctcgaatgacttgaaatctgaacagctagacgagttcactaagctcgagcgcagattaaaactgcgtgagacattaactaaagcgttgcaatggtctagtttgtatggggcagtgggtttattacttgtcactgacacaattaacatcacttcgccattgcagcctacagaacgattaaagcggttgattatcttacctaaatggaaaatttcacctacaggacaacgagatgatgatgtgttttcgccaaactttggtcgatatagtgaatataccattattggcggcacacaatctgttttagtgcatcattcacgtttattaattatcaatgccaatgatgcacctttatctgataatgatgtttggggtgtgtcagactttgaaaagattattgatgtacttaaacgctttgatagtgcctcagcgaatgtcggcgaccttatttttgaaagtaaaatcgatattttcaaaattgcagggttatctgacaagatttcagctgggttagaaaatgatgtggctcacgttatttcagcggtgcagtcgattaaatcagcaaccaatagtctgttgcttgatgcggaaaatgagtacgaccgaaaagaattatcttttggtgggttaaaagatttattgacagagtttcgcaatgcggtggcaggtgcggcagatatgccagtcaccattttgtttgggcaatctgtttcgggattggcaagtggagatgaggatattcaaaactaccacgaatccattcatcgattgcaagaaacaagattgcgtcctgtgcttgaagtgcttgatacattactatgcaatgaattatttggtgggcaacctgatgactggtggtttgagtttttaccattgacggtggttaaacaagaacaacaagtcaatatgcttaatacctttgctacagcggcaaatacgttaattcaaaatggcgtagtaaatgaatatcaagtagcaaacgaactgcgcgaaagtggcttgtttgccaatatctccgctgaagacattgaggaaatgaaaaatgttaatgaatttgccggaaattttgaagagccagaaaacacggaagatgcgcaagttcaagccagtgaagatgagcaagagaacggagctttggtatagacaacagcttaaacagttcgtcaaaacgatgaccgatgatgtagaaagagctatgcaacaaccgcaaggctctttttttatggatgatgcgaaagggttccaggcgattagtgcgaaagcgctgatgaaagtattagaaaagtacgaaaaatctgaccgcacttctcaagctgaaaatatcgccaatggcttcgttggtcgtggtgatgcacaaaaccatgctgaagtatcaaccaatttgaaaaaccaaactggcatcgatttatccgcttatttacgcaatagtccaaatattgctgaaagagtgaatgcattgaccgctggtaatatccagttaatcaagtctattcgctcgcaatatcttgataaagtgcaaaataccgtcatgcaagcaatggttcggggttctttaaataaagaccttgcagcacaagtaaaagacttaggtaaaacaaccgaaaaacgagcgatgtttattgctcgagaccagtcctcaaaattaaatgccgccttaacgcaagcgagacatgaagaggttggtataaaaaaatacatgtggtcaacatcgggtgatgagcgtgtgcgagaaagccatgcggaaaaagatgggcagatattcgaatatgccaatccgcctgccgatactggtcaccctggtcatgatgttaattgtcgatgcgttcagattccagtgcttgatgatgtagttaacttaaaatcagaagaaaccgaattaagctaccaggccgcagaacctaataagacagggaaaatggatctcgatgagttatttgaaagctctatcggtggaggtggtaataagtcattttctaactttggtggggttaattctgaattaattacgttagcgaaagagagtattggtttggatattacagattggcaacacagtattgatgaatcaagcatccgacacatattgaaacaacatggaaacgaaaaagcggaaaataaacgagggcaaagagccgttacaaaaaaagacattttattattgcctttggttgtctccgcatttgatagcattgagtacactgggacaagcgattcagggaatgaaacgtttttgattaaaaaagagattgatgacgaaatattcagcgtgcaggaagttaggaagagacacaagaagattgcagttaaaacaatgtggattaaaaggaaaaagaaagccacaagctccgcatagtgcttgactcacaaatggcgtctgcttaacgtccgaaacgtgctatgccctattgcctgtggcttggcttggcttattttatcactcttaagatactaaattcaactcggcctgaaattgccgagttttttattggggtaaataaatgaaatttacagacaaaaccactcaagcagctacacaaagaaccatcactaaagatggttttttagttgtgcccgcaaccatttctaaagttggggtatttgattaccttgctacagaactaggcttaaaagaagacggcattaaaaaggtcgctcgcacagagaaatcattgtaatgctcgtgtagagcttaattttacaatattttccattaattatttctttattatttgcacatcatttttgttcctcgtagaatacgagcaaccttacctttaaagtgcggtgaaaattgaccgcacttttcttacagtaaactatcctgagagataaacgagtatgtatcaattattccgtcacggcattttccaaatggatgctgaaaaggctcatgatttcacgattcaatgcttgaaattagccagtaatcctttatttcaaccgatcttaaaatctcttattcatgctcccaaaggctttccgaaaacggtaatgggtgtaaattttcctaatcccattggattggcggcaggggcagacaaaaatggcgatgcgattgacggctttggtacattgggtttcggttttctcgaggtaggaacagtcacgcccgttgcacaagatgggaatgcaaagccacgtcagtttcgtttgattgaagctgaaggcattattaaccgtaatggttttaataataatggtattgactatcttatagaaaatgtgaaaaacgcccgttataaaggtgtgataggcatcaatattggtaagaataaatttacatctttggaacaaggcaaagatgattatattttctgtttgaacaaagcctataactacgcaggttatattacggtgaatatttcatctcccaatacaccagatttgcgtcaattacaatatggtgattatttcgatgatttattgcgaagcattaaggatcgtcaggctattttggcaaaccaatacaataaatatgtgccgattgcggtaaaaattgcaccagatttaacggaaagtgaattagtgcaaattgcggatacattggttcgtcataaaatggatggcgttattgcaacgaataccacggtttctcgtgatacggttatggggatgaaaaatgccgaacagcaaggcggattaagtggaaagccgttgcagcataaaagcacggagattattaagcgattacatcaagaactgaaaggtcagattccgattattggtagcggcggcattgatgggttgcaaaatgcacaagagaaaattgaggctggtgcagagttgttgcaagtttattcaggattgatttatcacggtccaaaattagtaaaagaattagtaaaaaatattaaataatgacaaaaaaatacgatttacattgtcatagtaccgcatcagatggagtgttgagtccaactgaattagtgcatcgtgcttatgcgcaaggtgtgaacgtgctggcattatgcgatcacgatacgattgtgggtattgatgaagctgagattacagcgaaagaagtaggcattgaattgattactggagtagaaatttcgacaaattgggaagggcgagggatccatattgtaggattaaacttcgataaaactcatccaaaaatgaccgcacttttgcaaagtcaaaaagcattacgggaaaaaagagcggtggaaattggcgataaattagaaaaagcagggattcctcatgcttatgacggggcaaaagccttagccgatggcgaagtgacgcgtgctcattatgcacgttatttggtgcagattggtaaggtatctaatgatggtcaggcctttaaacgctatttagggcaaggaaaatcagcatttgttaaagctgaatgggctgatattcccacggcgattgagacaatccatgccgcaggcggtatagctattattgcacatccattacgttataacatgacggggaaatgggtgcgtaagctgatagtcgattttaaggcttggggcggtgatggaatggaaatggcggattgtggtcaaacaaaagatcagcgtcaaatgcttgctcgttgggcaaaagaatttaatctgctgggatccgttggctccgattttcatttcccttgtggctggattgagttaggaaaaaatttagatttagttgatagcgttatcccagtttgggaaaaattttagtcagatagagaatgttcaaataataaataccggtttccttgataataatttattgggaaacaggtattttttatggcacaaaatataaaaaactgaatttatccttgagattttttctgactatctaataaataatttggcggtaattcaggtgtagaatcttgttcatcaaaggattcaatttcaggtttgagataaaactctgtcgcttcatgattgcttttcgttttgcctaataattgtggctgaagttttacaaaagtactattcggtgcaagccaaatgccgataaatgcttgattaaatttagcatcaaaatcgtgttctaaaactgtatcatttaagacgaagtagcctctatcgggtaaggcaatatagttcaaaatatcgtttggtgagaaatcaggaaaggtcgcttgcatttctttaagccagctttgagtatcgccatcattaagttttaaggtttcgatttctttaatgagcgtaatcgcaaaattttttccttcaatgggtttttcatatttgaaagagagcattaatggacgttcattttcttgataagtgccagtttcagaaaacaaaccaatggtataaacatggaacggcccccaagtgtattcggcatttccgatgggttgccaatgagcaaaaggtgcggcagaaaaaaacgttatcattgccacaaaaagggatttcattttcataataaatagccgtgaataaaattttgttgattataacaaaccgcatcaaaaagcaaattagaaatcagtaaaaaggcgagtaattttactcgcctttgatcgttgtaatgttaatttgtgcgatgaattattttaagctacccaccatatcttctgggcgaacccatttatcaaaatcttcggcagacactaaacctaaattaatcgcttcttcacgtaatgtggtgccatttttgtgtgcggtttttgcaattttagctgcattttcataaccgatattcgtattaagtgcggtcaccagcatcaatgaattttcaagttgttgtttaatgcgtggatagtttggctcaatacccactgcacagtgttcatcgaaagatacgcaagcatcgcccaataattgagcagattgtaagaagtttgcaatcatcacagggttgaacacatttaattggaagtgaccttgtgaacccacaaatgcgattgtagtgtcattaccaaatacttgtgcacagaccattgtcatcgcttcgcattgagttgggtttactttacctggcataattgaagaacctggttcattttcaggaattaaaatttcgccaattcccgaacgagggcctgatgctaatagacgaatatcgttcgcaattttaaataaactcattgctaattgacgtaatgcaccgtgagtttcaacaatcgcatcatgagcggctaatgcttcaaatttattatctgcagtgacaaacggaagtgtggtgaattttgcaatgtaatctgccactttaacatcatagcctttcggcgtattcaaacctgtgccaaccgcagttccacccaatgctaattggcttaaatgtggcagcgtattttttaatgcttttaagccgaaatctaattgagctgcataagccgaaaattcttgacctaatgtgagtggcgttgcatccattaagtgagtgcggccaatttttaccacgtttttgaaggcttcagattttgccgcaaaagttttttgtaaacgttcaacacaaggaatggtgtgctcaactacttttttatatgccgcaatgtgcattgccgttgggaaagtatcatttgaagattgtgatttgttcacatcgtcatttgggtgaataatagatttttcacctaattttccaccgtttatcacatgtgcgcgattggcaactacttcgttcacattcatattagattgtgtaccagaaccagtttgccaaataacaagtgggaattgatcatctaatttatttgctaaaatttcgtcacaagccagagcaattaaatcacgtttttcaagaggtaatacacctaaatcatgattagcaaatgcggctgcttttttcaaatagccaaaagcttcgataatttcatgtggcattgatgcggctgggccaattttaaagttattgcgtgaacgttcagtttgtgcagcccagtatttatctgctggaacttgaacttcacccattgtgtctttttcaatacgaaatgccataaaatactccgttagttttgaaaaggtggaataacaaaatttagggtatatagtagcgattttgttttgttcaagcgataattttatgttggttttatgatgtagatcacaaaatgctaggtaagatatggattaaatataaaataaactcaatgtaattttccttccaaaagaaaaaatgcggtcaaaattaaccgcactttgacatacaaggcaattgggttatatttttctgtctgtctgtctgtctgtctgtctgtctgtctgtctgtctgtctgtctgtctgtctaagattatcccaagaaagatgatgataaaacaagtattcttcattataaaaacgaggagagttagctgaatgttcctttaaccaaggtttgttgctaccaatgtagtgaataatatgcggagtaaattttattttctctttatgttccatccataaatattcaataaatttaacctgaatattaaattttacaggtaataatttaatcaaattcgtaggtatgctaaaattaataacatcttgatctccatacacaaaaaattcaccatatttggcagcgtactcaataaaatactgctcaatgttattttctcgccatttatttagattaattaacatcactcccgcattaatatattgctgtttttcataaaatggatgttcccataaatattcagaaaaaaagtcactcacacccgcaattaagctatcttctaaattaatatcccataattcgtctatagcctgatgaataataagatccatatcaagataaataactcgttcaatatgctgaggtaaaatttgatgaagatataaacggaataatgaagcagtgctttggatgtgagcaggagatattacagttggaaatgagaattgattaatattaaattgaatatcgtacagtgtgttatcaaatttagcacaatgcatttttaatttttctaaactttcagcaggaataccatcgtgtattacataaatattgatgttattatgatggtagcaaagggattttagtacggtgtctaagtgactagcaaaattacaatctagtgtaaatacaatgttcattattactcctcaattttaatgttgattattcggatcgtgattataagtatacaagtaaaagcaatcttttgttttttcagtaaatcaataattgctggtgtaattatttcgttcttggttttggttaaaacaaaataatgcaggttattttatagcatagagaaaataaagtaaccttatttgtgatatcagtagaattgtcatttatgtgttaggcgtttgtagtgcgctttcggatatgccagttgttgtcccaacggtaaatgaatcacagcttttagaactaagacaacgtaacattgttagtttgccttatccataaataagccaacttgctttaacccttgcccctattttacaagggactaatcttaatcaaatgtttgttacctctttattgccagcgtcttatacaggtgtggaaaccgtaactaaacttgctggacaaacagcccatttattaaacagtattccattagacgaagaagatactcgctttgcatttgatgtctatccgcatcaaacaccctgtttatctaatcaattacaatgaattatttttaataatatctatttaattatttatcttctaaggttttttcgttaaaattctcagttttatatggggcaagattgagaaaataacggggctaaaatggcaaaaactgcacaattttatattcttacggaaaattgtactttaactgtcgaagaaatagcctgtaatcttgctgcttcaatatggcgttcagggaaaaaagtactaattagttgcgaaagtgagagccaagcattagaaattgatgaacttttgtggcaacgagatcccaatgaatttgttccgcataatttatcaggtgaggcaacacaatatcccacaccgattgagatttcgtggcttggaaaacgaaatttacaacaccgcgatttgttaatcaatttgcaacaagaaatcccagattttagccatagttttacccaaattattgattttgtgccgaaagatgatgcgttaaaaacacaagctcgagaacgttataaacaattacgtctgcaaggttggaatctttctactgaaaacgtgggttaataaatgaacgatattgccttttatcaacgctttcaattttgagtattgagcagtaggttttgaattaattaaagaggataattgatgactgaacgtgagaaaattattcaacaacagaaacaacttaaagcgttattttcagtttggatgaaagagaaaatgaatcacgaggtggttatctttcaaaaaactgatggcaagatagtcgagcattatctggatggttcggaaaaaattgtgggttatgcaaaataaagcgattttttattgtggaaaaatggttcgggaaaaagtactttacgttcttttaaccaagatgctgtgcaaattgtgattgattctgatcatattgcaatgcagattaatcctcaaaatccaagacttgctgatattgatgcaggcagaaaagcgatagggctatttcgttttgctattaagctacatattgatttttctatggaatcaacgctttcgggcaattcaattattcagagaataaagaacgctaaagaaaatggtttctatgtacatttaaattatattggtattaatcgcattgaaataaatcttgcacggattaaggcaagagtaaaaagtggtggtcattttattgctgaagatattgtaaaatatcgttattaaataagtttagataatttatttcttgttttgtcatattgtgatgaaatttttatttatgataattctagcattgcgcctgaattgatttttcaactaaaagataactgtattactcaatttagtgaatttttaccaagttggtgtgaaaaaatattgaataatttgagaaatctaggatttgaaaaaattttctaaaatataaccgctctttaaggagcaaaatgcaaccaaacgaaatcactttttaccaacgttttgaagccgatattctcgctgggcgtaaaaccatcaccattcgggacaaatccgaaagccattttaaagcaggcgatattttgcgtgttggtagatttgaagataatcaatatttctgcaccattgaagtgttaagtgtatcgccgattactcttgatgaactgacggaacagcatgcgaagcaggagaatatggggttggataagctgaaagaagtgattaaaacaatttatccaaatgaacatgagtcttggataattaattttaaacttattgggtagttttaaaatttgccaattattataaaggaaataaacattaataatgaatttttcttatattttagaacaacttaaaagttttactattgaggacgttattctcaaaatctgttattttgttatctcaattatcgtaggtaaagtttcacggcaatgttggaagctgattagaatatacgttaatgaatgtagaacgattagagagctttctgaatcagataaagaatttattcaaaataataattttgaatttgaagtcgataaggaaaatgaataccaaaatttagaagagctaaagcggaaaggattagtaaatattgagttttgtgaggatgaattacaagatgcctcaggaatttatttatgtactgtaacaaataaaaatagattaaaaatttcattaacgaaatttggaaaacaaataaaatatcttatagaaaaataatttagtactttagtggattagattcccacgcaacaaaaagagaaaaaataaatgacacaaaaattcgaaatggcagaccgttttaatccgtctgcggtagaacaagccctttatcaacattgggaagagagcggttattttaaaccgtctgaaaatgaaaatgcgccgagctattgcattgcaattccgccgccgaacgtaacaggttctttacatatgggacacgcattccaacaaaccttaatggataccttaatccgttttaaccgtatggaagggcataacaccttatggcaagcggggacagaccacgcaggtattgcaacccaaatggtggtggaacgtaaaattgcggctgaagaaggcaaaactcgccacgattatggtcgtgaagcgttcatcaacaaaatttgggattggaaagcttattcaggtggcacaatcagccaacaaatgcgccgtttagggaactcaatcgactgggaacgtgagcgtttcaccatggacgatggtttatcgaatgcagtaaaagaagtgtttgttcgtttgcacgaagaaggtttgatttaccgtggcaaacgcttagtaaactgggatccaaaacttcacaccgcaatttctgatttagaagtagaaaacaaagagagcaaaggctccctttggcatttccgttatccgttagcaaacggtgcaaaaacggcagatggtaaagattatttagtggtggcaaccacccgtccagaaaccatgttgggcgatacggctgttgcagtgcatcctgaagatgagcgttatcaatctttaattggtaaaactgttgttctaccactggctaatcgtgaaattccgattattgccgatgaatatgtggatcgtgaattcggtacaggtgtcgtgaaaatcaccccagcacacgatttcaacgactacgaagtgggtaaacgtcataacttaccaatggtaaatgtattgacgctgaacgcaaatattcgtgatgaagcggaaattatcggtactgacggcaaaccacttgctggctatgaagcgacaattcctgcggattaccgtggcttagaacgttttgctgcgcgtaagaaaattgtcgcagattttgaagcactgggtttattagacgaaattaaaccacacgatttgaaagtgccttatggcgaccgtggcggtgtgccaatcgagccgatgctaactgaccaatggtatgtgagcgtgaaaccgcttgctgatgtagcaatcaaagcggtagaagacggcgaaatccaattcgtgccgaaacaatatgaaaacctttacttctcttggatgcgtgatattcaagattggtgtatttctcgccaactttggtggggacaccgtattccagcgtggtatgacgcagaaggtaacgtttatgtcgcgcgtaacgaagaagaagtgcggtcaaaatacaacttagattctgcggttgaactcaaacaagatgaagatgtgttagacacatggttctcatcaggcttatggacgttctctaccttaggttggccagagcaaaccaaagagctcaaaatgttccatccaacggatgtgttaatcacaggcttcgacatcatcttcttctgggttgcgcgtatgattatgtttacgatgcactttgtgaaagatgaaaatggcaaacctcaagtgccattcaaaactgtgtatgtaacaggcttgatccgtgatgagcaaggtcaaaaaatgtcgaaatcgaaaggtaacgtacttgatccaatcgatatgattgacggtatcagccttgaagatttacttgaaaaacgcactggcaacatgatgcagccgcaattagcagagaaaattgccaaagcaacccgtaaagaatttgcggacggcattgctgctcacggtacagacgcattgcgttttacattagcggcgttggcttcaaatggtcgtgatatcaactgggatatgaaacgtttagaaggttaccgtaacttctgtaacaaattgtggaatgcaagccgtttcgtcttaacgaatgaaaaattagatttaagtgaaggcgagatcgaattctcattagcggatcgttggattcaatcggaattcaatcgcacagtggaaacgttccgtaattcattaagccaatatcgttttgacctttgtgctaatgcaatttatgaatttacctggaaccaattctgcgactggtatttagaattgactaaaccagtatttgccaacggcaacgcagcacaaatccgtgcagcaagccaaaccttggttcacgtgttagaaaaattattacgtttagcacatccgcttattccatttattactgaagaaatttggcaaaaagtgaaaggttttgtcggcattacggctgacagcattatgttgcaacctttcccacaagtggaagagaacggctttgatctagaagcagaagctgaaattgagtggttaaaagaagtgatcgttgcggtacgtaatatccgtgcagaaagcaacatcgcaccaagtaaaggcttagatctgttattccgtaatttaagcgcagagaatgcaaagattcttgaaaaacagaccgctcttttgaaagcaatggctaaattagataacgttcaagtgttagctgcaaacgaagcagcaccgcttgcggtagcgaaactcgttggcaatgcggaattactcgtgccaatggctggctttatcaataaagaagcagagcttgcccgtttaaccaaagagattgaaaaatatcaaaacgaagttaaacgcatcgagaataaacttagcaatgaatcttttgtggctaaagcacctgaagcagtgattgcgaaagaacgagaaaaacaagcggaataccaatctggattagaaaaaatccaagagcagtataaggcgattgaggcattgtaacaaaacataaaaagtaggcattatgcctacttttttatttttgatttaatcctaaaaaatctccaacttcgtgttcgagttggctcattgtgatcagagcctcttgggttttcttggcttcatcttcatcaataacactcattgcaaagctcacatgaacaagcacccatttgccaagtaaatcggctggatttcccagaaatatttacttcacgttgtacgctacatacatctactgtggcaagttgaagataatttgtatcaattttgacaatttgacccggaacgcctaaacacataatatttttactcctattggcatttaagctgaaatacagatttattttactattagatagaataaattattacaatctggatcaatagttgcgcatttcggattatttagtgatttctatgttattaaaattaataaatattattaaaaactaaccgtactttttcttgatcttttacgcccacagaactttctactcctgaattaagatccaagcctaagcaattttgttgaatggcttgttctacattatttggcgagatacctccagctaaaataatcttgtgcttaagatgttcgggaattaatgaccaatcaaaggttttacccgtgccgccttgttggttcgctgtctggctgtcaaaaatataacgatccacattcaaatcatcggtaaaatcgaccgtactttgggcttcagtattgaccgaaatcgctttccagatttgcgtgttttttggtagttgctggcgaagtgcggtaataaatgcttcagtttctgcaccatgtaattgcaccgcataaagctgcaactggttggctattttgacgataaagtcaatttcttgattctgaaaaacaccaacaaatcgaagtggcgcagcggttactaattcttgcgcttggcgtaaactcacacaacgttttgaatgttctacgaagattaatccgccgtaaagtgccccgttttcgtaaacgattttgacatcttgcgtgcgtgttaaaccgcatactttattttctccaaaaatcaccgagcgaaccgcattattcaaatcttggttgcccattaagctactcccaattaagaaaccatgcgccaccttttgtaattgatgaatttgcttgtgattgtaaatgcctgattcgctaataatacgtacatcagcagggattcggtcggcgtatttttcagtgagtttaacaacacgatttaaatccacagttaaatcgtgcaagttacgattattaacaccaatgattttcgcaccaagcgcaagggcgcgttcaaattcttcttcattgctggtttctgtcaatacgcccatgccaagagaatgtgcaagctctgccagcacacgataagtttcatcatttaccacagaaagcattaataaaatcgcatccgcttgatagtagcgagcaaggtaaacttgatattcgctaatcataaaatctttgcaaagcacaggttggctcacgataccgcgaactaacggcaagaactcaaaattgccttggaagtatttttcatctgtcagaacagatacagcagaggcataatgtttatagacattggcgatttcttccaaattaaattcagcacgaattaatcccttagaaggggaggcttttttacattccaaaatgtaagcgggcttttgatgcgtaccttttgctaacgcatcataaaaagagcggtcagagttttgaatgttttgtttaaattgtgaaaggggaaattccttttcttttgctttaacccattgtgctttatcaagcacgattttttgtagcaccgtagcggaatcaatgggtttggtaaaatcttgagtgatcatcatttttcttcttattgtggtgtatcaaattagctttttattaatatgtggttaatttctgtaatgttttaaaggcgttacctgatgcaagatgcgccaatacattttgcacattttgttttaaatcatcgtaaccgaataatttcaataataatgccgtatttgcagccaccgcattagcatgttcagcctttcctttgccttgtaaaagtgcggtcagatattgggtattttcttgtggttcaccaccgcgaagactttcgagggattgcgtttttaagccaaaatcttcaggcgttaaagtgaaatattcaattttgccatttttaatttctgccacttgtgtttcgccgtgcaatgcgacttcatctaagccagaaccatgtacaacaaaggaatgttgatgttctaaggcaactgcggtttcagcataggtttttactaattcaggcgcatatacgccaagtaaatgataagttgggcgagcaggattgataagcggccctaaaatattaaatatagtgtgcgtttttaaagcggtacggactggtgcaacatgacggaagccagaatgatattgttgagcaaataaaaaacagacaccaatttcatctaatgcttgtcgagcttgctctggtgtgacgttcacattaacgccaagtgcggtaagcacatcgctagcacctgatttactcgacacgctacgattgccatgttttgccacttttgctcccattgatgccgcaacaatcgcactggctgtggaaatattaatggtgttttgtccatcaccacccgttcctacaatatccgcaaaaggataatctggacgtggaaatactttggcattttgtaatgaggcggcaaccgcacccgtaatttcctcagtatttgcttcccgcacttttaaagcaataagcattgcagcaatttgttcattggaaagctcaccttggatgactgcattaaaaagtgcggtgctttctgaggttgaaagtgaatgtccgctataaagttgctctaataattggttgtgttgcatagtttattcctgtttttctttgtatatggatttgttaattttctatattttattaaacataaatatcgtaatctaaatcgcgtgcctcatcgcctgtcattcctcggaaaccccagcaatgtgccggttgttctttaatcgtaatttccacatcgtgagctcgaataccgagtttgtactctaattcgctaaatagcatttttatcaagcgtttttttgtaccttccatacgaccagccatcaggttaatttcgatgacggtgtaatcatcgctacgatcaaaagggtagtaaaaatcttctttttctaaacacaaaaagcgaatcgcgtgcttgccttttggaatgtctaatccgagatgaagactgttataaattacttccgcgagttgttcacgacgtggtgcgagtttggatttaagtccgaatacggtgatcattttttctcctttaaagtgcggttaaaaatcaccgcacttttttctgtcttatctatttaacaaccattcaattgattgttgtaataattgcgaaccttgcacagttaaaatactttcagggtgaaattggaatgcgcaaatgggtaaatcacgatgacgaattgccatgataatgccattatattccgcattgacgataaattcttttggtaaatcttgtcccattaaagaatgataacgcgccgcaggcattggattagcaagatctttaaacatagcttcgttatcatgggatatacgagaaactttaccatgcaacacttcgccagcgtgaacaaccttaccaccaaaggcttgaatcaacgcttgatggcctaaacaaattccaataatcggcacttgattttttaagcgttcgatcaatggcagtaaaatccccgcttctgatggtgttcctggccctggagaaagtgcaagaatggtatcaagtgtattgatattgagtgcggtttctaccagtttttctaagtcgcagtcattacgataaattgtgacgttgtgacctaatacacgaaattgatccacaagattgtaagtgaaggaatcgaagttatctaaaaataaaatattagccataataattcttccttattttgcttgtgtattaacttgacgaattgcttttaagacagccgctgctttatggcgtgtttcatcggcttccatttgtggatcagaatccaatacttcaccgcaacctgcttgtacatgggctatcccattttgtacgaaagcagaacgaatcacgatacaggtatcaaaatgtccatcagacgtgagataacccaccgcaccaccgtaactatggcgtttttgttgctcaaattgataaataagctgcatcgctttaatttttggtgcaccagttaatgtgcccatattcatacaggcttgataggcgtgaagtgcatctaattcagggcgtaatttacccaccacacgagacactaaatgcataatgtgagaatagcgatccacttgcattaattctgccactttacgggtaccattttggcaaactcgagcaatgtcgttacgcgctaaatcaactaacattaaatgttccgcttgttctttatgatcaagacgaagttccagttctaaacgtgcatctaattcaggatcaatgttgccgtgagcatcaaaaccacgagggcgtgaacctgcgattgggtaaatttctaactgacgattttctggcgcatatttcagcgcactttctggcgatgcaccaaacaaaataaagtcttcatcattcatatagaacatataagggcttggattattttgtttgagttgagcataactggctaatgtattagggcaagcaagggaaaaacgacgagaaggcacaatttggaaaacatctccaatattaatatggtgttttaaggcttttacgataccagtaaattcaggatcgtcaaagtttgttttaacttcatcacttgccgatttaatagaaagaacgtgatcaatattttttagtttttgtgcgatagaaagcgaggttttcgcaatattgacttgttcttcttgagcaaaacagaaacttttaagtgtcgcttgttgattttgatggtcgatagtaattaagtgttcggcaagatagaaactgtaatcagggcagttgataccatcattttttaatgtaatgccatccattggaatgaaatttgcgacgagatcgtaagcaaataatccgcctaaaaaaataggcgtttggctatgttgataaagagtagaaacaacacgcaacccatcaaaaatagtagcagactgtaatttattatcttcatcgagttgattatcaagtggcgaaaattgtacagaaaattcgtcttcaaaattgaccgcacttatttttccaagtgcggttaattttggatgaatttcttttaaaacttgttttccattcttatttaaagctttaaatgtgacgttgtgacctaagcacgttattttaaccgcagcattaactaaaataagactttgtaaactatttttactccctatttcggcagagtcgagtagaagagaatttgaattaggttggcaaagtgtattaaaaatagcggtggtatcagcataatagggaattgattgagctgtcaccgcaataaaggcttgagtttgaatgttcatatttatccttttggaaaattttgtactattaaactagtacaaaagaaataagtcaagcctgatttttattttttatactttttgattaaaaattgtattttttattcctttgcccaagggcgacctccataatattctatattttgctgatttatcacttctaatatttttgcagaaatattattgttatcttcatctgacaaggataattgaggaaaaacacgacgaacagcaattagtttattgaaatcagctctgtatttaacggtatattttcctgaagtttgacctattaaccccaaactttttaaggcagataaaaagctgcgatcaccaattaatggtgtgttccaactatatgaagttttttgtgcaatctcacgaggtacggcgtaacaattagtatcaatatgtccattaacttcattaaaagtaaaatgtatttgtttctgaatatcttctattttaacatctacgaaaatatcgctttttgtattccaatttccgagagagtcaaaatcatcattgcaaataaattgatgatttgaatcgtaaaaagatcgcaaggaataagcaaaatcagcaccttgctcaatcacgtttactaagctttccacgtgatcttctcgtagctgattgtcatcatctaaataacaaataatgtcttcttcaacaagaaaagctgctactgcgttaattgcaccgttaagtattccattttttcctgtattcattggcaaataaataggaattacatcaggaaattgttccaatatagatttggctttatcccagaaaatattgccatcaacaaatacataatgcttacatggataagtttgattttgtacgcttttaatagccaaagataattctggacgacctattgttgaagttactaccgcaacggttttattattttggttggttggttggttggttggttggttggttggttggttggttggttggttggttggttggttggttcatcagtataaatccttttcatttttataataccttgattaactcaaaatatgcaatagaaaatattttggaaaatttggaataaaataatctggcagacacattattttaaataaaagatctgccagatttgataatctataattaggctttagtagagagattacctaaatccttatcaattaggaacaagcctttgccatcttctccaagaaaatttaatttatctaaaatactactaaataatttttcttcttcatgttgttcttccacataccattgtaagaaattaaatgcagagtagtctttttcttcaaaggttttacctactaattcattgattttactggtaattaatttttcatgctcataggtagcttcaattacttcttttaatgatttatattcatgtgcaggtgcttcaattgcagaaattacagcaagtgagccagtttcatttaaataagtaaataatttacgcatatgttgcatttcttcagcagcatgaactgataagaattttgcagtgccttcaaagccttgctgatcgcaccaagcactcattttgtaaatataaattagaagaataaaactctaaattcatttgatcgtttaatagttttactacattttctgataacatactattttctcctatctattccaaagttgcgagttcacgatcaataaagaataatcctttaccatcttcgccaacaagattaaatctatcaataattccactaaataatttttcttcttcatgctgttctgctacataccactgcaggaagttaaaagtagagtagtctttgctttcaaaagtaacttcaactaattcattgatttttgacgtgactaatttttcatgttctaaagttatttcaaaaacttctcttaatgaagaataatcatgtttaggtgcatcaatttttcctaaaataggcataccactagtttcacttacataattaaacagtttttgcatatgttctaattcttcatcagcatgacgaagtaagaaggtagcagccccctcataaccgtgttttgaacaccatgcactcatttgtaaataaacattagaagagtagaactctaagttaatttggtcgttcagcttgtttatgattatttgattaagcataactaattcctttccattttgattgataaaatgcaataaagcgtaatttgcggcaatcattttaaattcacaaatgataattgcaagtttttttatcaaaaattttgatataactaattaattttaaaaagaaaaataaaaaacaattattatcatttacataattctataaattaaatatgacgttgtcacaataaaactaacaaattttaaattagtattagatatgtctttactttcctccttagatttggatgaaaatttagattatcgagtaaacatgaaaacttaccaacttttattaaacctaaagatcgttatcaattaattgacaaatgtaatatcattctgctagaaaaacacggtcaaatttacctgtacttttcttataactactttcttttgattatccatttaaaatttttcatattgtcatcaaactgtcacaattattttctacacttcgctacgcaatctaaataacactcaaggagaatttgttatgtttatgcataaaatgaaaaaaaatcttattatcgttttaaccttaggtacgttaccttttgctcaagctaatagcatcactggtgctggagcgtctttcccttatccaatttatgcgaagtgggcatctttatatgagaaagaaactgggaataaagttaattatcaatccatcggttcgggcggcggacaacagcaaattattgcaaaaacggttgattttggtgcctctgacgatccaatgaaatccgaattattacaacaacaccaactagtccaattccctgcggttatcggtggtatagtgcctgttgttaatttgcctgaaattaaacctggtaaattaaagttatcaggtaagctgttagcagaaatcttccttggtaagattaaaaaatggaacgatcctgacttagttgcattaaatccaacgcttcctttaccaaataaaaacattattgtgattcatcgttcagacggctctggaacaacatttggcttcactaattatctatctaaagtttcgaacgattggaaaaatcaagttggtgaaggtaaatcagtgaagtggttaacaggtcaaggtggaaaggggaatgagggagttgcttcttatgttcgccaaatgaaatacagcattggttatgtagagtatgcctatgccaaacaaaatcagcttgcttggatttcattacaaaatcaagcagggcaatttgtacagccttctaatgaaagtttcatggcagctgcaagtcacgcaaaatggcacgaaaaggcaggaatgggtgttatattaaccaatgaaacgggggaaaaatcttggccaattacggcggcgagttttattttattaaataaatattctgacaatcctgaaacaactaaaaatgtattagccttttttgattgggcattctcaagagggcaagatgcggcaactgaattagattatgtgccaattccagctgatgtggtgtctaccattaaaagtcaatggaaaacagagctaaaacaataaaaatctctttattttataccgcactttatacaaaacctagcacttaacattaataaagtgcggttatcttaaataattttggaaaatacttatgctcacaaaaagtcggaaatattttaatcaaacatggattgaatcattattcaaacagactacggcattgtttgctttgcttgtgtttattttacttgctgctattttaatttctttagtcataggaagctgggaaagtattaaacgttttggtgggagttttctattagaaacatattgggatcctgtacaagaacaatatggggcaattattcctattttaggtacgcttattacggcgggtatcgcattatttatcgcagtacccatttcatttggtattgctatttttttaacggagctagctcccaattggctaaaacgtcctataagcattgcaattgaaatgctagctgcaattccttctattatttacggaatgtgggggttgtttgttttcgttccattatttcaagaacatattcagccagtactaattgacaatttggggaatttacctggattagaattatttttttctggcgtaccttttggtgttggtttatttacggcaggattagtgcttgccataatgatcattccttttattgcatccgtaatgcgggatgtctttagtatagtaccaccaatgttaaaagaaggtgcttatggattaggtgcaaccacttgggaagtggttcgacaagtgattgtaccacacactagaatagggcttgttgggagtgtgatgctaggattgggaagagcattgggcgaaacaatggctatcacttttattataggtaattcgtttcaattgcctaattccttattttcaccttctacctcaatcgcatctgctattgctaacgaatttaatgaagcaggtggattacaaaaatctgcattgatggaattaggattacttctctttgttatcacaactatggtattgattttatcaagattaatgattacaaaaatgcaacaaacaaaagggaaataagatgaaaactaatcaaaacttgcgtttttattggcgtaaaacacacaataaattaatgttagggctttcctatatttcagtcattatcggcttattttggttgtgttggatattattcactctaattaccaaaggcattccagctttatcaattgatttattcacacaatctacccctgcccctaatgaaaaagggggattgttaaatgcactgattggttcgttttttattgtcggtgcgggtacattgataggcacgcctataggggtattggcaggaacgtatttggcagaatatggtcgttatagccgtttcgcacaaattacccgttttcttaatgatattcttctttctgccccttctattattattggtttgtttgtttacagcttatatgtatcaaaaatcgagcatttttcagggtgggctggagcattcgcattagctttattgcttattcctatcgtggtacgcactacggacaatatgttattacttgtaccaaataatttacgtgaagcagcggcagctcttggttgctctcaatggcaagttattatgatgatttgttatcgagcagctaaatcagggattttaactggcgtgctattagcagttgcccgaatttcaggagaaactgcaccgctattatttaccgctctgtctaatcaatttctatcttggaatatgaatgaacctatcgcaaatttacctgtagttatttatcaatatgcagcaagtccttttacagattggaataatctagcttgggcaggtgcagctctaataacattatttgtgctttgcttaaacattttcactcgactcttctttcaacataaaaaataatgaggcaatatgattagtctacaagaaaccaaaatagctgtgcaaaatctaaatttctactatgaggattttcatgcattaaaaaacattaatttacgtatcgctaagaataaagtgaccgcctttattggtccttcaggttgcggtaaatctactttattgcggagttttaatcggatgtttgaactatatccaaatcaaaaagctactggtgaaattaatttagacggtgaaaatttactcacaacaaagatggatatttctctgattcgtgctaaggttggtatggttttccaaaaaccaacgccatttccaatgtcgatttatgataatattgcattcggtgttcgtttgtttgaaaaattatcaaaagaaaagatgaatgaacgagtagaatgggcattgactaaggccgctctttggaatgaagtgaaagataaattacataaaagcggagatagtttatctggcggacaacagcaacgcttgtgcattgctcgagggattgctattaaacctagtgtgttgttgttagatgaaccttgttcggcattagatcctatttcgactatgaaaattgaagaactcattacggagttaaaacaagattatactgtggttatagtaactcataatatgcaacaagctacacgttgctccgactatacggcattcatgtatttgggtgaattagttgaatttggtcaaacacaacaaatttttgatagacccaagatacaacgtacagaagattatattcgcggtaaaatggggtagttattttgagctcactcttattaaaaagtaaaagtttggtgagaatgtattatttctcacttcacttttatgccataaatcaaatgaaggagtattatgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgcttacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaatttaagtagtacagaatttaaattgttacatttttttatgaggcaccctgaaaaagtttattctagagaacaattgttaaatcgtatttggcataatgatctagaagttgaatatcgcactgttgatagctatattcgccgtttacgccgtaatttagctccttttcaatgtgaacattatatccaaacagttcgaggatctggttatcgattttctagttatttacgagataaacaatgaaaaaaatattgaattttattgttgaaataaatttggcaatcattatttccttatttacttctgattttattctttggtttgcaataatacttttattaattttagcttggcatcatattaatgaatatcgtttactcaaatatctcaatttaaagcaagataataaattctctttattacaattaggaacattctctcaaactgaagcctaccatcgtcatcaaatttacaaagaaaaatgtgcaagtttacgtttgttatctcaaataaataaaaatattaagtatttaccagatgcaattattatctgtcagcataatggtaatatttcttggtgtaattcaattgcgcaacagatgtttgatttttgttggaataaaaaagtccagaaaaatatttttgatgttattttttatgaacaatttaaacattattttttcagtcaaaaaaaaagacgaccgttagtactattaacttataatcaacgttatattgaggtgcagtcgcacgcttataattctcatatgattttagttatcgctcgagatattacagatatgattcatttacttaattcacgccaaaaattcttgagtaatattaatcacgagctacgtactccattaaccgtattacaaggttacttagaaattcttgcagataataatattcagaaccctctacaaaaaaaggctatttttgcaatgcaagagcaaagccaacgaatggaacatctattacaacaatttaattttttagcaaaaatagaaacaacttcagataaggattttcgtaaatttgatatgtcagccatgataaattctttaagaaaagatacagatatattaaatacttataatcatcatattgaatttattattcagcctaatatcattatttttggaaatgaatctcaactaagaagtgccgtttcaaatttaatttataatgctattaagcattctggtaaacagtgtcatattcaaattcaatgggaaacttgtgaacagggtattaaatttaacgtgatagataatggtgttggcatatcaccacagcatattccacatttaacagaacgtttttatagagttgatgaatctcgtagccatttaactggtggaagtggtttaggactagctattgtgaagcatactttattacaatatcattctcatttaaatattgaaagtactgaaacgaaggggagtagtttttcgtttatcatacctaaacgctttgtcatatcaaaaaataataaagaaattcaatgataatacgcgttgcaagtattagctgacacggtagtaaataacacatcagaaaatcgaaaatagcgggctagtggagagcttagatacataaaaaacacagcttggtagtttttcacccatctaaacttatattatttagattatgtagcagttgctaaatcacctaaatctttatcaatcaagcataaatctttaaatgctgcagtactttcacacccatgaatcgaacactgtaaataaacatcatagtatggctctaaattaatttactcgttcatcttatttgattaagtataactaattaagagaggagaaataatctctttataacctataattaaagttactttgcatttttacaatttaacataatatacattatgcgaaattagttatcaggttagcggaaactacggattaaataaatcacacagttatgcacaagtcacaggtactagcaaaacaagacaaaataaggctagataacacgttgtaacgcgtcattttatagagttattgaacggatgaattgaaatgtaaaggaaatgtaaagtgaaataagcttaaatctatgtgattacgctacgtaaaatctggagaatttcttggatattttcttccctgaaaaacaacaaaaaaaagcacgtttttattaaaacgtgctcttctaaaaaatgtgacaacgtatcgactaacctagtaattttataccatattcatatacttgttgtagcaaagatagtttttcagaattatctgaatgttcctcggctaaacgttgtaaacctgattgaaactctaccgcacttttttcaagtttattctgtcggtatttttgccatttaatttgttcagcgcgtgtgagggttttataaaagtggcgagcacgataatggaacaataattcaaggatacgtttatcttcaaaagctaaaccatgttcagataatttttctgcaggtaaactacgtaaaatagccatattatttttatcagcattgctaaaaaagccattgtataactcagtttctacattatcattcgatgcaaattgacgttcttcattaaaaatatccgccactttttcacgaatatcaaaagatgctcgtaattttgcaagattatccaagcataattgtcgatcaatacccaatcgatttgctgtttctggtaacaaagttttagctggtgctaaaataggacatttattaatatgcacaagttttaacggaacggatgaaactcctctttcttctaattcagattttttggtatataaatctgtccgtaattcatccgcacttttggctaataaattatcgatatcgccagttaaatcacacacaattaatgcattttgatttgtcggatgccaagataaaggtgcaacccaagtgcaatttccacgataattccctagcattccagaaacatgcactaaaggtgtcattgcgcctgtatcaactaatttttcgatttcttttttaccgcgattttcaaagaaatattggaataatttaggctgtttttctttaattaatttcgccatagcaatagttgcatatacatccgccatggcatcgtgagcattttcatgctcaataccatttgctttagtgagtttttctaagcggaaacttggcattccatcatcgtcataagcccaattaattccttctggacgcaaggcataacaggctcgcactaaatctaacaaatcccagcgtgaattcccatttttccagctgtattcataaggatcaataaaattacgataaaacgtataacgcgtcatttcatcatcatagcgaatattgttataacccatgacacaagtattgggttgggaaaattctgctaagatatttgcggcgaattcaggctctgaaagccccttttcattacattcttgaggcgtaattcctgtgaccattacggcttcaggagccggtaaataatcgttggtttgtttacaataaaacattattggtttaccaatgatattaaaatcagcatctgtacgaatacccgcaaattgcgcagggcgatctgttgctggatttacaccaaaactttcataatcgtaaataaaaaagctgaaatcttttgccatgactactctcttttacgcgataagtttatctaaataatataggcagaaaatagccgataaactaaaaataatacctagccaatttagcttactgattttttctttaaaaactaatgcgccagttatcgtacctaggcaaattaccccgatattcattcccgcgaaaacaagcgtcggatttccagcaaaactttgatgtgcttttatatagaataaaatattaaagaaattcaatacacctaaaacgatgccgccaattacacttgatgatgtccattgcgcacgttttaagaataaatagataaacataacgcaagctgcaagcgagaaagaaataaacaatgttgcaggaaatgcaccaccgcttttcgctacttgtttgaataaaatatcaatgatgccgtaaccaaaccagacgccgattaatcctaaaacacctttaaaattgaccgcactttgcccttgagttggcttagttaataaacaaaataaaccaataaaggctaatacaacgccaatgattttagattggcttagtgtttcatgaaaaattaaaaacgctgctaaaatgggaagaaataacgaaagacgttgcgctgcatctgaacgtacaattccagcaaactccactgcttttgacataataataaatacgctaggtagcaataaacctagtgctaaaaaaatgggtgaattttcgctttgtgcaatgtaatcagtaaactctaagcctttaaaatcaggtttaagtaagaaataactgaaagtgatggctgtaatgtagttgaatgcgatagcttgttcaataatgatattttttttacgggcaattttcagtaaaactgaaactgctacgctgcaaagaatggcaaaaataagattgtgcatttattaatccttaatagcttgtttaattaaactcataatgtattcaagatattgggtgctttcaatggtgatttcataatctccattcccccagtgaccagtattagatacattttttgctaaatttttaggatcgtctaactctccataaggaagattaatccaaatttttaaattcttttgttggatacgaatatctgcaatatttcgatcttttttgaatgcaatgtaaagttttctagtattaatttcgatattaggatctaaatttaaaatgccttgtttaaaatcttcgtatagttcttgaataaaatctgatttatcacttaagtgatcagattcttgataaacttttatttcttttaatgtagaaaattcttcatttttttcaatagaaacagctttaatattcggtgctgattttgatttattaataatattgagcgtaataatatcattatcaaagcgattaacttcccataattcaataggtaaatctttaaaatttgtggcttgaatttggaaatcattaaaagtaggtgaaacaaaaatcaccttagattgtgaccaatccacatcatttcttttaagtggggctttttgcttttcattatattccacaataaaatcagctttatattcaagcatcaaattaagataagaaatcccttgatcaaccacactagaattttgttgtcttttatattcaataatgacaaaggcttgagtttcaggatcaaaagctaaggtatcaatacgcgaatttttaatagaaaattctgagcgaataaaaatatagccacttaataaggtaagattttcttcaaataaacgctgaatatccttttccagcttaaatttttgctgcttcagctgtgataattgtcctttttttgatgtaaagattttcattattccttccttaaaggcttaagtgcggtcaaaaatcttaaaattttaaccgcacttcccttctattttttattctgtcgcaccgaatcctcgtaaaccaacaacgtgtacatgctcttggttgcctgcgattttacgcacgagtttataggttgttcctttttccgggctaatgttttctggcgcagcaataagcaactgcatatccaaacgttcgcaaagttcgaataaggtagaaatagatttaccgtctaaacgcgctgcttcatctaagaacaacaagcgacaaggcacaatatctttgcctcgaattcgacgactttcttcttcccagctttgaacaaccattaagagaattgacatacctgtaccgatagcttcaccagtagaaagagcgccactttcagcgcgtaaccaaccatcagcgccacggaatacttccacttcaagttcaagataattacggtaatctaacaattcttcgccgattgtttgtgctgtgcgttgtcccatatcaatatgtggattgatacgttgatagagcttcgccatagcttcagaaaaggtgatgcagttgtcgttaaataagtcttgatattcatcttgctgaccagaaagtgcgtccaacaacatggcatgggtatcacgaatattcactaccaaacgaacagattttacttgaccaaacgagatgttttgcaaaccttgattgagcatacgaatacgattttgttcacgctgaatcgttttacgcataatatttgcaacactttcagaactgatcgccaattttttctcacggccagttaattcagccgttaaacgagaaagctcaatttccatttgttcaatggcatcaattggatcatccgttttaatgatgtcttgacgaatacgttcacgtaaatgctgatacaccgcaataaagaaccgcactttattttcaggtttgcgactatcttccgacactcttaggctatcacgtagatattcattatctgccaccgctgtacgcaacgcacctaatgctttatccgacattgaacgtaactcatctgcagataaataagcgagctctcggcgattgaggcgtttttccatatcagaattacgtgatagacgtaaaactacacaccaactcactttcgctgctaccactaattcacgttgagtcttataatcgcgttcagttttgcggattagacgatttaagttgtccgcttcactttcaattaatgtgagttgtttttctacataagaacgacgctgacggctcgttgaaagttgttgatgtaattcatcacgacggatacgcgcgcgttcttcagcaccatcatcagctctcacgccaagatcgctaatttcactaatcaattcatttaaaagctgatatttactatcgtaagagctttgtaactgaatcaatacgcgattatattcagcaaattgactttgtttttgacgaacttgctcacgttgcatatctcgctgagcctgcatttgttctaaacgttggcgaagtttttcgttgagttcagaagttttagcctgccctgcatcttcataaccaaaatgatgtttacgttgtacaacatcagctaacgcaaatacacgttgttgaacttgtttttgacgctcaatcgcttgagttaattcattttttaagccgtcgtaattttctggatcactttgtaaactattggcaatcggctctaattgtgacaacgttacgccatattgacgaataaaatattcatcttgctctgcaatatctaattgttcacgacattcttcaatacgatcaattaaatcttcatcagtcaatacattgagctgtggaattaacttgttgagtaactgtagtttttcttttgcattatctaattgaatgcgtaattgttgttcgccgttattgaattgatttaattcacgatcaatttcattacgttcgcgattaatctcagacattaactcttctggatttggctggaatgccagcgccaaatgcaacccaacaaattggctgaaatgttcgtgtaaacgttggcatttttgtacatcaaacgcaatttgggcatattgttctgccacttcatcacgttcaatttgtaattcttctaaacgtttttcacgtgctgctcgcccaaataatggaatttcagggaatcttgaatagcgtaattcacgatctgaaacttgcacgacaacacctagctcaagttcttgtgcggacaatacgctgtcgtcaaatgcggtaggatcgccttcaattaaatataaatcatcagggcaatcttctaattgcgcaagttgttcacgcactgcattgagatcacgcacaacaatagcatgacgtgcaggtccgtaaagtgcggagaaataaggcgcatcttcaatggttacgtcatcgtaaagctctgaaagcagtacaccaccaaaacgttctgccagcatatttaaacgcggatcttctgaaccatctggctgacttaaacgagaaatttgctcatctaattgcaaacgtttttgttcaagttgatcacgttgcatcgtgagttcacgttctttcacaagttgtgattgcataaagttcatcacatcttggctatgttcaaacgtctcgccactttgttgctctaaacgttctaatgcagcttgagctgtcagccatgctggtgctttacgcgcattttcatcataaagtgcggttaaattttcacgtttttgacgaagcgtagaacggttttccacttgttctgaaagtcttgctgaaatatcttcaatcaacgcttcttgctctgcgtgataatcctctaattcttctgccgtttgtaaacttaaattagcacgttgattaaaatcattaagtaatttgaccgcactttgttgttgtgcataacgttgctcaagttcatgtaattttgtgcgaagttgtggcgtttgttgtgcctgcaatttttggcttggatattcacgtaataattctttcgcactttcccacgcgctcgagcgtggaatttcgccggcaattttgcatactaattggtacgctttatcgaactgagattttgccgcttcagaaatagacattttgtgctcaagttcaagcacagtttccgttaaactttcagcatgggcttcaaattctgcgtgataatcttctacatttttaacacttaaatcagctaagccacacaaggttttagccttttcgagtgcagtaatggcttgttgatattgaagtgcgcgagtttgttgggcatctaatgcttgttgataatctgctaattgcgctcgtacagcgtcaatttcaatttcagtttgctcaaattgggcttggctttcttctaacgcatcattcgcatcttcaaccactattttttgttcttctaaacgctcggtgagttctgcaatatcttcttgatagcgcgtgattttttcttggtgacgcaaagcgtttaacactaagttaagatgatcaaccgcactttggtgatcaacttctaaagtacgttcattttctgccaattcagccgcttctcgacttaaatcaactaaacgatgttgagataaattctgctctgcttttgctttataccactcgcgacgagattctaatgcagcctcaatattgccacggcgttcattcgcattacgcatataatccgaagcaacataattagtggtttcagtaattaaatgtttaaataaattgcgatctgattgcgtgaccttaatcgcctctaaagtcatacggttctcacgcaatgcactttccatatcttggaaagctttgcgcacacctaaattttctggcaataaatagtcacgtaaagagcgtgtgattgcactggaaataccgccgtataaagatgcttcgataagtttatagaatttgcttcggtctgatgctgaacgtaaacgtttcggaataatacctaaatcgaacatcatgccgtgataatcggtgatggaatgatattgtttaaattgtgcaccgatattttcaattttatctttgagttcgtttaaattaaggacgcgagcttgacgttcgcccacggtttctgtgaaaagtgcggtcggattttgagataattctacaccttgaattgaaaacgtttttaaatcaacctttttatcacgacccgcaatttgctgcagacgcacaccgacaagaatacgttgatgacgtgagttaatggtatctaataccgcgtaacaaacacctggacgcaatttaccatgtaaacctttatcgcgagaaccgcctgtggagccagcctctgttgtattacggaaatgtaaaagggttaaatcgggaattaatgcggtcacaaatccagccattgtggttgatttacctgcaccgttaccaccagaaagcgtggtaactaattcatctaaatcgaaagtacgggcaaaaaaaccattccagttaattaaggttaaagaacggaatttaccacgctctacaccattatttgtcgtcatgctaaaaggcataggtgcgtcaacgatttcttcgacgttttcattttccataatgacttcatcgctctctaattcgatttcattttctaattcaaaaacatcagacattattcttgttctccgtcaaattcttcgtcaatttcatccgcactttctgtatcgttttccactaattgtgcttgtttttccaacgataaggattcaggtgttgccgcttccccatcacgaatgagtctagcttgggcctctaatggatcatctccgctacgcacttccgccccaaaacgaaatacagattcagaaatagtaaatttcccactattttgttcgccaacggtttgaatcatacctaaacgacgtaaacgaccaattgcagctcgcactttttctgccaatttttgtttatctaagtcagaaccacttgaacgctgattaactgcttttaataattttccttcatcagcaagatttaataattcatcatacacttcttgcgtgctaaaaataccttgttgggctaaacgttctgggcttaaataaagataacaaagcactttaccaacaagcatttccaactcagaaagtactgaacgtgcaattaatgtcgttgctttcgggcgaagatagaagaatccttctggcgcacgaattagttccacgttatagcgacgataaaatccgtctaattcattttggaaatccattaaaaatgcgtgattatctaaatgctccgtgctgatatggcgacccgagcgcaatagactatctaccgctggaaatattggatttgcaatcgccacagcgagttttggggaaattacatcttgaaggttgtctgtcataggttatttctcaatatctaatgctttattgtattcacattcatgaaaaaagtgattgaaatctactatatcggttgcaggaaattctaaacttatttcatttctgatatgttctaatatcttgcttcccactaaatatgcagatttcccgcgcaatgctttatcgtaccattttattagatctgcctcagtgataatactctgaatcttagaacgccaaccaatttgatttaataaagacaaaataagtttttcttcactctctttacatacaataactattcggtcagatgaaactgaagatacaatgttttcagctaattcttcagttaatgataaatgttttatttgaattgccataccaaaattagcccacatatccaaaccccgatctgaagcatttgttacaccaactctattaatttttgcattaagttccaaactagtattctcactatcaagagaaataatttgacgagtaaaatcttcaaactcctttaacaaatcaatattcgataaatctaaatcaatttttactttaacgcctaaagcctctattaaagatgaaaacaacgcataaacaactatttcataaactttatcaatacttcgttttaaaccgggttctaaccaaaaaagagcaagaaattcacttagatgaaaattatctggagtacgagaataactatactctaaggctgatgacatctgattaaagcgttcaaaaaactttttataaatataactttctactccaccatttgtttttctattcatttctcctaatatatttaaatgtttgggaggcatagcgttatcattaaataaatcgtcttgatatttagctgacgatgttgatactcttcctaaaaaacggatacaaataacatcccgccattttttagaaatatttcgatatgtttctttatctaataaattaatatttttattaactctatcttgataaagaatttcagcaatttgtataggcttgtataaatgtactcttgctttctttataattttatctaaagattcttttgctacttgaatatcgttcatttttagtccaataatgaaagttgaattgcttgatttattttaggcgttgccatatttaaactattaatcattgaaccagcaatagccctaattacaggaatactaactgaattgccagcaactttacgtacctgagaataaggtatattaatttcaaaagtatctggaaatccttgtaatcttagcatttctcgcccagttaatcgacgtaccccatttacaactagataattataacttcccccagctcttaatgcacaagagtatggaagagcagaaacatttcctgaaatattttcatgccaaattgaaggataaggcacatctttagtaattgaacttaatcttttccgttttagttcatctgaaagaaaataattattaggaacaacatcatcactctctaatatattagaaagttcttcatactttcctataggctttggaaattcaaaatgcaatttatctaaaaaacccacaatgtaaattcgctctcttttttgtggtaatccaaaatcaagggtatttaatactttatgatataccgtatatcctaacttatttaatttatcgttaataactttaaatgtattaccattatcatgtgttgttaatctttttacattttccagcaaaaaagcttttggttttttagctttcaaaattgcttctatattaaaaaataatgttcctctagtatcagcaaagcccaatcctttaccagcaatactaaatggttggcaaggaaatccagcaagtaaaatatcatgatctggtatatcgctaggagatatatcattaatatctccaaaaggtttttcgccaaaatttacttcatacatactttgagcatacttatcccattctgatgaaaatacgtttttacatccaaatgcttcaaaacctagacgaatgccaccaattccagcaaacaaatctattgttttatattctttcatacttattactaattaatacttatcaatcacatgcgcttgcacttcagcaccacgtttattaattgcttgccaatctggataaatacccgataaatcatcattcgccataccaaggcgtactgcttgatcaacaatgattcgagccacatcaaaatgacgagaaagtggataattttccagttgttcttttaacactaaactcaaatcaatcggacggttattttcacgataagcaatcagtaagccttgcatatgctctacaatttgatcgtgtaaatcagaaagggattcgtattgcaattcttctggtaattcacctaaagcatcatcttcacgcaacaccatttcttcatcacgcagatcgactaaacgctcagcttgcgctgtccataagaaccaaggatgctcaaaataatgatgaatagaattacgtaaacgttgtgagaacacacgatttttatccatatcaatggcagttcggataaatttatgtacatggcggtcataaccaatccataaatcaatggcttgttgtccccagctaataatacggtctagtttggattgcaaatccgtaatcaactgatcgataaaatacaaatcatctcgcccaatcacacaatcttgaatacgcaataattgcgcttgaagtttatcccctgcggcatttagcgtatcttgcaattcacgcaaattcccagatgtttcatctaataaacgttcacagcttgaaattgccgcttgccaatctttagtaagaagctctgcaatttcatctttaatactttgctgattttcatccataatacgttgtgaaagatcgatgctatcaaaaatctctgcaacggaatattttaatggcgcaaacacattacgacgccaataatgttcactttcattattctccacaccctcttccgcagaatcagaagcacgttgaatttcatctgccacaatggaaagttgcactgaaagacgcaatgcggaaaattcacgctgacgaatgtaataatcagacacaccaacacctaatggtgttaaacgataaatcgccaagccctcagtaaattcgctactaaaacgatttaacaaacgttgtttcactaattcattaattgcattattcgctcgtgttgcaatggcatcggtggattgctcaaaagcattcatcgtgtggcggaaaatatccacaagatcggcttctaacatttcgccgtctaaacgttcgttgttataaattgcaatcgccagcaggaaaaccaagcgttcggtaggtaaattcaaagaaaactcgcgatcttttgcccaagagacgagttcaggaatagtttgggatgtttcaatcattgaattgcaaagcgttaaaattgaacaaaaaattggaaagattatacaggattttttgcggatcttaaaaatcttcttttgaattgaccgcacttttcctatttttcacgtataatgtgcgactttcatgaataactaaagataacagaatgacccagttagcccaacaagaaaaaaaacaaacctataattttaataaattacaaaaacgtcttcgccgtaacgtaggcaacgccattacagattttggaatgatcgaagatggcgataaagtcatggtgtgtttatccggaggcaaagacagttatacgcttctcgatattttgttgaatttacagcaaaatgcaccgattaaatttgatattgtggcagtgaatctcgatcaaaaacaaccagggtttccagaacacgtattgcctgaatatttagaaagcattggcgtagattacaaaattgtacaagaaaatacttacggaattgtgaaagaaaaaattccagaaggaaaaaccacttgttcgctctgctctcgcctacgccgtggaattttatatcgtactgccacagaacttggtgcaaccaaaatcgctttaggacatcaccgagacgatatgttagcgaccctatttttaaatatgttttatggcggcaaaatgaaatccatgccacctaaattgatttctgacgatggtaaacaaattgtgattcgtccgcttgcttattgcaaagaaaaagacattgagaaatatgccatcgcgaaggaatttccgattattccttgtaacctatgtggctcacaaccaaatcttcaacgccaagttgtaaaagaaatgcttaatacttgggatcgccaatatccgggacgcttagaaaccatgttcagtgcaatgcaaaacattacattgtcacatatgtgtgatccgaaattatttgatttcaaaggaatcaaacatggacaactaattgatggcattgaaggcgatacagcatttgatgaagaaaaaatcacaccaatgcaatttgaagacgaagatcaaactgatttttcaaacaacgaaatgattaactttaaagaagtaaattaatatgttgaatatcaatggaattgaagttgaaactgataaagatggttatttgctccacagccaacaatggaacgaagatgtcgctcgtgctattgctcggttagaaagtatcgaattaacagatgcccattgggaagtgatttactttgtacgagacttttatcaagaatataacacctctccagccatccgtatgttggtaaaagccatggctgaaaagcttggtgcagataaaggtaatagccgctatttgcaacgcttatttcctgaaggccctgcaaaacaagctacaaaattagcaggtttgccgaaacctgcaaaatgcctataaaagtgcggtcaattttttaaaagttttaaacgcttagtttattaacgacttgttttttgtaagataaaacacaggctcttttaaaccctaactaacaaggaaatgttatgaaaattagtgcaagaaaccaactaaaaggtaaagttgtttcaatcgaaaacggttcagtaaatgcaatcgttcacattgatatcggtggcggtaacgtgctttcttctactgtgtctttagctgcagttaaagaattaaacttagaagttggtaaagaagcatacgcaatcatcaaagcaacttctgtaatggttggcgtagaataatttcttccataaaacagaattgaatataaccgcacttttaaaagtgcggtttttttatttctttgatacctcttttaagtcgaattccccttgcatttataaattttaaaaatataatgataatcattcttatttatatcttttattttagggaactatactatgtatcaaaaaaagccattaatgttgttattctgcacaacatttgttagtccatttgttatggggaaaactattgaaacaaccaacaaccaacaaccaacaaccaacaaccaacaaccaacaaaaatatattgcccgaaattgttgtgtatggcgacaataataaatcactttcttccgttaaaacactctcttctgacgagataagtaaaacgcctacatcaaacggtaatatcactgattatcttcgttctaatccccatattcgttatgaaaatagcgaccaagatggttttcaacgtggagaaatcaagcctgaaaatatttcaattaacggtgccgatccaaatcaaactgcttattttgttgataatgtcaatataaataatgaacttactgctgatagcgatatttttgatggttctatgcaagttgtacccggaattagtcacactcaagcttatttctttgatgcgactatgctttctaaagtggaggtacaagatagtaatatttctgctagcttagggggatttatggggggtgccgttatagccaaaacaaaacaatatagcggcactgatagcataaaacttaaatatcgcacgacaaattcctcttgggcaaaaatggaagctggagactcagtacaaaaaatacttaaacaagtaagaccagatcttgtcggagtggcagagctacaacctaaatatgataaacaaacattcaatattttggctgaaaaaaggctaaatgataatttaggaatggtttttggctatagccgtagaacatcatctattgaacaaaatcgtttaattggctttgatcaaaatgccaataataaagcacagttagacaaacaaaatcatcaacgactttccgataatcttttattaaatttcaattggacaccgcaagaaaaagaacgtattgaactcggtttacgttattcaaattataaagaattgaaatatttccaggaaaatataaataacaacgtaagcgattatcatcaagcattggggacaacactagcttgggtgcattcattcaactctggcgtttggacaaataccttagcatacgatcgttttaaagataagcgtaaatcatcctcaaatagtgttgaaacaacatctgtgttagatgaatattatgaagcgctttataattttgaaaaaggcgggcatggtaatagccgtttaacccaagataatttacatttttctactgaatatgtaatggatcctttttatttagcttctacggagcattctgtttctattggtggaatttatcaggcaactaaatatcaattctatcgtccacaagatgttcattcaaaaataacattatctactttgcaaagtgatgggagtatgaatattttcagatcagataaaagtacaacaccaaaagtcgtgttaaaaccagctatcaaaatatcgctatttatgctgaagatttaattaaatggcgtaaatttgaatttcgacctggcattcgcattgaacgtaatgattatttaaaaaacaataatattgccccgcgttttgttgcacgttaccgaccttgggataatacaggatttacactaggtttaaatcgttattacggtcgttcttttgcttcgttaaaattagcgaatggtattttaaagcttaataataatccaacacgtcagcatcagaacttttcatccctaaaaagcccttatgcagatgaattaagtttaagttttgaccaaaatatgggtaatttagcactgaaactcggttatattcatcgtgataataaaaatcgtatcatattgaaacgagagactataagggaaaacataaaaactagttatatcaatggacgtccattcggtgttgatatttatactttccaacttaacaatatagaaccttggaaattaggtaaaacttattggactacgtcacttggttttgattggttaaatacaaaacgagctgatggcgaagaatttgatctaaataaacttgtttctttagatggtaaattaatgacttatcgtgaaatgttacgacaagttaatagtaacactgaagattggattgctcgtttaggtattgatatgacgataccaaattacgatattacttggtcaaataaagtgtatatgaaagcaccaattcgtcgttatgatttgattaacagcgataacgatgatgacattccacgctatcgtagctatcactatggcagacacacacaatgggatagcagcattcgttggcaaccaaccattagaggtaagcatagcgtttatttgcaagtagatattttaaatgtacttaataaaacacgtaaaaataaagtcgctactgctatttctaccagcgatgaatatggtgtctatacgcctgggcgtgaattttggctagaagttggctatcaattctaattttcttcaatgtatagggcttatgggtttttgaaatgtccaccagccctactctacgctagttttacttagcgtagagttttcttttttctaggtaaaaataatgaaaaaaacaaccgcactttttttacttatcttttcactaattgcttgtcaatcattggaactatcgcccaataatgatttaccttttgatccaaatattcagcacggtaaactatcaaacggtttgcaatactttgtattaaaaaatactgaacccaaagaacgcgtttatattcgattagtaattaatgcaggctcaatgcacgaagatgatgatcaaaaaggcattgcccatttagttgaacatatggcatttaatggctcaaagaaatatccagaaaatcaaattattaatgcgttagaaaaacttggaatgaagtttgcacgagatattaatgcttttaccgattttgaaaatacagtctatactttaaatttagatagcaataatcagcaaaaattagaattggcttttgatgttatcaatgaatggatgaataatattacttttttgcctaaagatgtggatggcgaacgtggtgtagtacaagaagaatggcgaagacgtttaagcccaatgttacgtattggcaataagaaaagtgctattgaaatggcgggttctcgttatgtattacgtgatcctattggagatatggatattattaaaacaatttcagctaaacgcgtcgctgatttttaccacaaatggtatcgaccagataatatgtcagtaattattgtaggcgatattgatacaaaacaagtagtaaaactattaaaacaaaacctatcccaagaaaacccaattactaaaacaacattggaaaaaattgattttaatattcctcttatcaacaaatggcgattagattctatttctgaacaaggcacaacaattccaagtattgaattaagtttttttgaaaatacaattgaaaccaatacattagcgagctataaacaagaattaattcagcaaattaccactcgattacttaacttacgtttacagcaatgggaaaaggaaacagaaaatggcgtagattctgcaaatttttatcgtactcatttaggtaaagaaaccctacaaagcattttttctctccagcttatagatacacaatattcaaaaacgatagataaattatttgcctttattgccagtataaaacaacaaggttttactcaaaatgaattaaacggcgagattaaacgcttaactcaactcaatgaaaaacaattaaatattcgttctggtagtttaaaaattgccgatgatctcattacttctgtggcaaataagcaagtggtattgagcgtaaatgatcgttatgaactcaataaacgttttttatctcaaattacattagctgatttacaacgcacgttaaatcaaaccttagcattaaaagcaaaattattattaatcactcaacctttgccacaaaaagccttgccttttgatgtagtagaaatagaaactcgttggaacaatgcaatgaaaatgcaacaacaccaatgggatgaaaaaaaacaaatcgaaaaattaccgcacttaacatttaacacaggctcactttcccaagaaaaatactgggatcgcggcgatatttatgaatttcgtttaagtaatggaagtaaattgatttaccactatagtgacaaaactccaaatcaagtacattttcgtgctgttactcaaggtggtttacgttctatcccagataaggactatcacttattgcgtgctgccgttagtgtagttgatgaaacaggtgttggagaactttctctttctgcggttaatcaaattttttcgcgtgatccattggtaattgcaactgtgattgatgatgataaacaaggttttactggtgtatctaaacctaaagatttggaaaatttactgacattgttccgcttaaaattacgttcttcgcctatatccgatcttgccttagaaaaatatcgacgtgaaacccgtgattatttcaaacagattgatttagaaacacaatttatgcaagccgtttcaaaactgcgttttccaaatattgaaactgtctatactcaaaaacaagcacagcaattagcatttgataaaaaccaattaagtaacgcttatcaacgttatattttaaataaaacagattttacctattttattattggcgatattgagcttaatcaagtaaagaaattggcagaacgttatttagcttctgttgaatcaaaaactcagatacgtcactttgtccctactattattcatacaccaactcaatcatttattatgaatggtttgaaagaaccgagagctgatgtagaaatataccttaccgcagataatacttggcgagcggaacaaaaatacttattcaatattcttgctgatattgtgcaagaaaaattacgcttaattctacgtgaaaaagtttcaggtgtttattctgtaaatagttggtttatgcaagatgttcatacaccacaaattgagggaaaaattgaatttagttgcgatcctaagcgagtagaggaacttacgcatcttacaaatcaggtgctagatgatattgtaaaaaatggcattgatgaaaatttattacgtaaaaaactagcggaacaacatactcagattcgacgtgaatttgattctttagtttcagttgcttcgattattgaagaaagttactggcaacaagataatccagatgccatttatacctatcaacatttagatcagttagcgacaaaagccacaatagatgcgttggctcaaaaagccctaaaaaaatcaggcagatttgtcagcgtattaaaagcagctacttattagaaaataaatgaaatctcaatagatctgaaacagataaaaataacggtgatcgcttaaacgatcaccgttaaattgaactcactgtttaaacagtaaattatattggttattttcgagaagtattactcttcattcaataactttaattcacgacttcttacttgatttttcaagatttccgcaaattcttccacagtaaatgtacctaaatcagcacctttacgggtacgtacagccacttttccttctgcgatttctttatcgccacaaacgagcatataaggcacgcgacgtaaagtatgttcacgaattttgaagcccactttttcatttcggaggtctgctttaacacgtaaacctgcatcagataaggttttaacgacttgttgtacatagtcagcttggctatcagtgatattcatcacaactgcttgggttggggctaaccacgcagggaagaaaccagcatattcttcagtaatgataccaatgaaacgctcaatagaacctaaaatcgcacggtgaatcatgacaggggttttacggctattatcttctgccacataagttgcatctaaacgacctggtaatgcgaagtctaattgcactgtaccacattgccattcacgacctaaacaatctcgtagtgcaaactcaattttcggaccatagaatgcgccttcaccttcttggatttcatattcaagaccgttgtgtgctaatgctgctgcaagacctgcttccgctcgatcccacatctcatctgaaccgatacgattttccggacgagtagaaagtttcactgcgatattagtgaaaccaaaggtgctataaatgtcgtacaccattttgatacagctagttacttcgctctcaatttgatcttcagtacagaaaatgtgcgcatcatcttgagtaaagccacgaacacgcattaaaccgtgcaaagaacctgatggttcattacgatggcaagaaccaaattccgccatacggattggtaaatcacggtaagattttaaaccttgattaaaaatttgaacgtggccagggcagttcatcggtttaattgcgtattcacggttttcagattgagttgtgaacattaaatctgcgtaattttgccagtgacctgttttttcccacaatacgcgatccatcataaatgggccttttacttcttgataatcgtattgttttaatttagtacgcacgaacgtttcaagctcacggaaaattgtccagccatcattgtgccagaacaccatacctggtgcttcttcttgcatatgatataaatctaatgctttaccaattttacggtgatcgcgttttgccgcttcttctaagcgtgttaaatattcagcaagttgttttttatccgcccaagccgtaccatagatacgttgtaacattttgtttttgctgtcgccacgccagtacgcaccagcgactttttgtaatttgaaatgctgacagaaacgcatatttggcacgtgtggtccacggcacatatcaatatattctaagtgatgatataacgcaggcgttgcagtacgttcaatgttttcatctaaaattgccattttgtatggctcgccgcgtttttcaaaggtatcacgcgcttcttgccaagtaacacgttttttcacgacgtcataatttgtttttgccaattccaacatacgtttttcgattgcatcaatatcttcttgggttaaagagcgatctaaatctacatcataatagaagccgttttcaatagttggaccaattgccatttttacatctgggaataattgtttaatagcgtgtccgagcaagtgagcgcaagaatggcggataatctctaaaccgtcttcatcttttgcagtaataatttctaacgttgcatcttgctcgataacatcgcacgcatcgcgacgttctccgtttacacggcctgcgatagtggctttagcaagacccgcaccaatatcttgtgcgacttcaagaacagaaacaggacgatcgaattgacgttgggaaccgtcaggtaaagtaataattggcattgttttttccttatacagtggtcacccatacgaaaggtgacgtgttcatttaaaattctatcaaaattaaccgcacttttgccctacttggcttcattcctaccattgaacgagcgaaattaggcaaaaaatgcgtggcgaattctatcactttcttgaagtattgttaaataaatgcccatattttacaaaaaggaaataatgtttttctgactaaaggctttatctcttaaaaataaagactagaataaccgcacttttaactaggtagcaaggaataaaaatgagcaacgtattagtattaaaatctagcatttcaggaaataactcgcaaactaatcaattagctgattatgttatcgaaaaattacaaggtaataacattgtagtacgcgatttatcccaacaacctcttccatattttgataccgcagctgcaattgctgtgcgtggagaaccaaaaacaacagaagaaaaacaacttctggcgttgtctgataaactaatcgaagaattaaaaaacgcacaaacattgataattggtgcgccgatgtataatttaaacgttccaacacaattaaaaagctattttgattttatcgcacgtccgcgcgttactttccaatatacagcaaacggctctgagggtttattaaaaggcaaaaaagccattgtgttatgtgcatttggtggattgtatgatgaagaaaatctagtgacacaatatatgaaatcaattttaggttttattggcatcacagatgtgcaatttgtttatgcacaaggcattggattcgggccagaggcgattgaaaaagcccaagcgtccgcaaaaaataaaattaatgaaattgtagcagccctttaatcctcagataatctaaaaaatataagaaaatgtattaaaaacaaaaaagtgcggtgattttaccgcacttttcttcttatttctttcgttcaacccattttccattggtgaaatcaacaatccatttagtcgcttttccctctttttcagaagtgacatattgttttttctctttgcgactaaaacgaacaatcgcttcattctcttctgggtctttttgtggagcatcggctaaataagctaatttttcaggtaaacgctcgcgatattgcacaagttcagcgattttaactgggcgtgtttcgcgggattttgggaagttatgtgctgacataaataccccactcgcaccatcacgcaatacaaaatatgcatcagatttttcgcattttaactcagggaaatgtactggctcttctttcggtggtgcgacctcgccacttttcaaaattttgcgcgtgttatcacaatttgtacatcccatatacttgccaaaacgaccaagttttaaatgcatatccgcaccgcatttatcacactcaacaacagggccatcataacctttaattttgaatgagccttcttcaattaaatatccatcacaatttggattattaccgcaaatatggattttacgatgtgcatcgattacatagctgtccattgccgttccacattttgtgcaacgtttacgatccattaatgctttagtttctgaagattcatctaaaacatttaataattccgcttcaggaattaaattaatcgttgttttgcaccgctcttttggcggcaatgcataacccgagcatcctaaaaatacccccgtacttgccgtacgaatggccatatttctgtcacaggttgggcatttaatatcggtttccacgagattattcggacgcataccgccttcaagttcatctaattcagctttagaaagctggctagaaaaatccttaaagaattgattcaattcagttttccaatttactgaaccagaggcaattttatctaaggtatcttccatattcgcggtgaaatcgtaattcattaattcgccaaaagactcattgaggcgatcagtcacaatttcgcccatcttttctgcatagaaacgacgattttcagtgcgaacataaccacgttcttgaatagtggaaataattgccgcataagtggaaggtctgccaataccacgtttttccaattcttttactaaagccgcttcagtaaaacgagcaggtggtttggtaaagtgttgtgttggttgcacttcttttaaagcaagtttttctgacacagtaactgaaggcaattcttgatcttcaggatttttacctatctgtggcaatacttttgtccaaccatcaaaacgtaaaattctgccttttgctttcaaggtataatcgcctgcggaaacggtcagcgtgctactatcatattgtgcaggtggcatttgacatgctaaaaattgacgccaaattaaatcataaaggcgcaccgcatctttttccattccctctaaggattcaggcaatgctcgaatatccgatggacgaatagcctcatgtgcctcttgtgcattttctttactagaataaaaatttggtttttctggtaaatattgtgcaccaaaatgattttcaatatagctacgcgccatattcagcgcatcttgactcaaattggttgaatccgtacgcatataagtaatgtaacccgcttcatataaacgttgggctaacatcattgtcttcttaacgccaaatcccaagcgagtacttgccgtttgttgaagtgttgatgtaataaatggtgctcgagggcgagaacttgttggcttagtttccaaatctgtgacaacgtaatctgaaacattcagaaaatctaccgcactttgtgcttctttttgattttttggatcaaatttcttgcctttataatccgtaacatccaagcgtatagcttgtttattttgattattcgtaaggacggcaacttcccaatattcttcaggctggaacgctttaatttcacgctcgcgttcgactaataatttaaccgcaaccgattgaactcgaccagcagaaagcccgcgtgccacttttttccaaagtaatggtgacaccataaagcccactactctatctaaaaaacgacgagtttgttgggcattaactcgatccatatttaattgttcaggcttttcaaaagcctgtttaatggcatttttagtgatttcgttaaacaccacgcgactaaaacgatcattgttaccaccaatcacttcacgtaaatgccatgcaatcgcttccccttctctatccaagtcggttgcgagataaatgtgatctgcttttttagcaagcgactttaactcggaaaccactttttctttaccaggcaaaatctgataatttgctttccaatcgtgataaggatcaatccccatacgtttaactaaggcgttacgttccttttctgccttaatttttgctttttcttcggcatccatacctttggttgaaattggtttagctttttcacctgtactagaaccaaccgtcggcaaatcacgaatatgtccaacgctcgatttcacgacatattggctacctaaatacttattaatagtttttgcttttgctggcgactccacaatcaccaaggatttactcatttgattacctaatatcactagaattttgtaaaattggcggtatagtgcaaagttatgttggcaaaatcaagcattttttcaaaaaaggtctataaatggataaactcaacgcgatttctattttctgcaaagtcattgaaactcaaagttttacattggcagcaaagcaacaaaatatttctgtggcgatggcaagcaaattagtttcacaattagaagaacatttaaaaacacgattgttacaacgtaccaccagaaaaattatgcctactgaagctggaataatgtattatcaacgctgccaaggaattttacttgatttagatgaagcagattccagcatcacccaccttaccagttcattacaaggaaatttactgatttccgttcctcgtgattttggtttactttttattgcaccaaatttacccacttttatggctaagcatcctcatttgcatattgaagttgaatttaatgataagaaaatcgatttattatccgaaggctatgatcttgctcttcgtattggttatatggaagatagctcgttagtttcacgtaaaataggaactactactgttcattttgcagcgtcgcctaattatcttgaaacgaatggtattccacaaacgcctgatgatttagaacatcacaatggcttactttataaaaatgcaatgaatcaggtaaattgggttggttcacgtataaatcaaacccaacgtttcaaaatccaatccaaagtggtaagcaatagcggttttgccttattaaatatggcaaaagcgggactaggtattgctaatttaccaaaatttattttaggtagagcctttgaaaaaggcgagcttattgaaatattaccagaatataaacaacaaaaattagaaattcatgtggtctatccaaacagaagacatttaccaataaaagtacgggcatttattgaatttttatctggcttaggcttgtgttcagaaattttggaaaatcatgaagataatatttaaatgctataaataaaaataccgcacttaagcaaccccaagtgcggttatttttatacgtgttttttataatgcttttaagatatcttcaacgcgatcttttgcatcaccaaagagcatttgcgtattctctttgaagaataatggattttgtacgccagcgtaacccactgccattgaacgtttgaacacaatcacattttgtgctttccatacttctaacacaggcattcccgcgattgggctatttggatcttccatcgccgctgggtttaccgtatcgttcgcacctataaccaataccacatcggtatcagcaaaatcatcattgatttcatccatttcaagtacgacatcgtaaggtactttcgcttcagctaaaagcacgttcatgtggcccggtaaacgtcctgcaacagggtgaataccaaaacgaacgttcacaccacgttcacgcaattttgccgtaatatcagcgactggatattgtgcttgtgcaacagccataccatatcccggcgtgataatcacagaacttgcatttttcaacaactcagctacttcttctgctgtagtttcacggtgttcgccttgttcttcgcttgaagaaacttgaacatcgttaccaaaaccacccgcaatgacgctcacaaatgaacggttcatcgctttacacataatgtaagaaagaattgcaccagaagaaccaacaagcgcacctgtaacgatcagcaaatcattattcaacataaaacctgccgcagctgctgcccaacctgaataagagttaagcattgataccacaactggcatatctgccccaccgattgatgccactaagtgccatccaaatgcaagcgcaatcgctgtcattaataacacagggaaaatgctttctggattattcaagaatgcaaccatcaataatgcagataccacaagtgcggctaaatttaatttatggcgatgcggtaacattaatgcttttgaattaatttttccgcttaatttaccaaatgcaacaacagaaccagtgaaagttactgcaccgataaaaatacctaaaaatacttcaacattatgaatattcgttaatactacttgctctgctacaaatgcggcttgtgctgctgcatctaatccttctggcattaacgcctcatggtgtaaaccatagctattaaagccaacgagtacagctgctaaaccgacaaaactgtgaagaatcgccaccagttctggcatttcagtcatttctacttttaatgcacgttgaacaccgattgctccaccaatgatcatcgcaataatgatccaaaatgttccttcagaatgagggccaaaaatggttgcgataagggcaattgtcataccaacaataccgaaccaacaacctgctttagcagtttcatgtttagaaagtcctgccaagctcataatgaaaagtaatgctgctaaaatatacgcagcctgtactaaaccttcagacattgtgcgctccttaaccttttctaaacattgctaacatacgttgtgtgacacggaaaccaccaaaaatattgatgcttgccaccaaaatcgccacaaaagctaacgcatcgataaatagattgcctgttggctgacgaatttgtaataacgcacctacaataataatgcctgaaattgcatttgttactgccattaatggtgtgtgaagtgcatggctaacattccaaaccacgtaataacccaccacacaagctaaaacaaatacggtgaaatgtgataaaaatgcagctggcgccacagaagctaaccaaaggaataacacgccaacaccagccatcacaccgtatttcacacgaggatctgttggtttagattcttttttctctgccactggtgcagctttggtttcttgttttggttgtgcagacacttgaatttgtgctggtggaatttcttccccatcacgaacaacggttacaccacgaagaaccacatcttcaaaatcaatattgatattgccatctttctctttgcacaaaagttttaataaattgactaagtttgtgccataaagttgagaagattgcgttggtaaacggcttgggaaatctgtataaccaatcactttcacttggttttcagttgtaacaactttccctgcttgcgtatattcacagttaccgccagttgcagcggctaaatccacaatcaccgaacctggtttcattgaatctaccatttctttggtgattaaacgaggcgctggtttacctggaatggctgccgtagtaataataatatcgacttctttagcttgttctgcataaagctccatcgcacgacggttaaattcttccgacatcactttcgcataaccatcgccactgccaccttcttctttgaaatcaatttctaagaagctcgcacccatactttgaacttgctctttcacttcaggacgagagtcaaaagcacgaacaatcgccccaaggctatttgctgcaccaattgccgccaaaccagccacacccgcaccaataaccaacacttttgctggtggaactttacctgctgcagtaatttgcccagtaaagaagctaccgaattcatgcgcagcttcaatgacagcacgataaccagaaatattcgccatagaagaaagcgcatccaatgcttgcgcacgagaaatacgaggcaccgcatccattgctaacacattaatttttttcgcggtgagttttttcattaactcaggattttgcatgcgccaaataaagctcacgagagttgctccttccttcatttgagcgatttcttcatctgtcggtgcatttactttgaagataatatccgattgccaaatttcagccgacgtaccgatcttcgcgcctgcctctaaaaatgcttgatcttcaaaactagctttaaaacctgcatcgtgttccacgatcacgtcaaagcccaatttcaatatttgctgaaccgttttcggcgttgccgccacacggctctcattctcaagcagctctctaggtacaccaattaacatactgtttccctctgattgatgattgggttaatgaaattaatgaacaaaccttcgcctattcatcgttaaaatgacaaaaagtcaaacggatgcaaatgtatcattaattgaatgaaaataggtaacgtttttaagtggttttacaagatattgtgatagggatcacgaaaaatcccacataaaaacatctcaaaaatttaccgcactttccataaaaaaacaccacaagtaaaaaacttgtggtgcttttaattttattattaatcacctaattgaacaggctcaactttccaaattctctccgcatactctttaattgtgcggtcagatgagaagaagcccatattcacgatattttgaatagtactttcaatccattggtcgcgttgtttgtatttttcatctacggctttttgaatttctacataactgcggaaatcagcaaaagcttgataataatcgtggtattgcaagccttgtaatagttgatgataacgttgaggttcttctggtgagaatttaccctcaataatttgatccacgactgtgcgtaattgagcatcgttttgatagtattcaaatgaacgatagccgtcgcgacgaagttgttccacttgttctaccgtattaccgaagatgaaaatgtgattttcgcccacattttccaagatctctacgttcgcaccgtcaagtgtaccgagtgtcaatgcgccatttaaggcaaacttcatattactggtgccagaagcctctgtgcctgcaagggatatttgctctgaaatatctgctgctgggatgataagctgtgcaaggctcacgctgtaatttggaataaatacaacttttaaacggcctttcaaacgctcatcattattgatgacattagcaacatcattaattaaatggatcgtttgtttcgcagcatagtaagccgaagccgctttacctgctaaaataaatacgcgaggttgccaatctttttcagggttggcaagcatttcattgtagcgagcaataatatgcaatacgttcaacatttggcgtttatattcgtgaatacgttttacttgcacgtcaaataaggcgtgcggatcaagctctacccctaactcgcgttttacgtattccgctaatttcactttattagcaaatttaatgtcagcaacagcctctttaaatgctttttcttgcgtaaatggtttaagtttttcgatttgacttaaatcacaacgccattctgaaccgatatatttatcaaacaatgcggctaattgtgggttcgccacggctaaccaacgacgcggtgtgataccgtttgttacgttggtaaagcgttctgggaaaatacgagcaaaatctgcaaaggttgaagttaccattaaatcggaatgaatttcggcaaccccgttgattttgtgtgaacctactacggatagccatcccatacgcactttgcgttggtagccttcttcgataagagaaacacggcggataaaatcgttgtcagtcgttacataagtgcggacatattctaagaagtgatcgttaatttcaaaaatcatctgtaaatgacgtggcaagatttttgccatcatttccacaggccaagtttctaacgcttcggacattaaagtatggcaggtgtaagagaaaatgttacgcgtcatctcccacgcttttttccactcgaaaccttcatcgtccactaaaatacgcattaattcaggaatcgctaacgctgggtgggtatcatttaagtggatcgccactttatccgccaagttttcaaggctgtcgtgggtgcgtttgtgacggcgtaaaatatcttgaagcgatgcagagactaagaaatactcttgacgtaaacgcaattcgcgaccattccaagtagaatcatcagggtaaagtacacgtgataaatttttatttgcggagtgctcttctaatgcggctaaatgttcgccacggttgaagtcggcaaggttaaacacttcgcctgcgtgtgccgaccataaacgtaatgttgctgcagaattattttgataacctgggatcatttgatcgtaagcaagtgcggttactttttcggtatcttgccaaatacattttttgccttcgaaatgaatgtttccaccaaattctacggtaaagcgtttagatggacgaataaattcccaaggtgctcctttttcaagccatgcatcaggacgctcgacttgctgaccattttcaattttttggcggaacataccatattcataacgaataccgtagcccatacccggtaaaccaagggtcgcaatagaatccataaaacaagcggctaaacgacctaaaccaccattgcccaagccaggatctacttctttttctaaaacttcttctaaatccacatttaattcagaaagtgcttcctgtgctaatccataaatgccttctgcaatcattgcattagatagcgtacgcccgattaaaaattccattgaaaggtagtaaacacggcgagaatcttctgctcgagtttggcgagcagtagtgatccaaccctctgttactaaatcacgcacagcgtgaagtgttgcattgagccaatcgcgttggctggcttcacgtggagagcgaccgattaagaaaataagtttgtaaacgattgattttttaatcgcttcaacggtcatttcaggacgattatattggaatggagaatcaaagttatccattatcataggtaaaacctctattagaatgctaagaaatgattaacgtagggtgtgtgaattttcaaaattcacgcacgtttgcaaaaatcaatcaaaatttgaccgctctttgaatgcgtgaatgttgtttacacagcctacaaagtagttcgaattttatgcttatctttgcaaaaaacaagcacaaccacaccgcttgcaaaatattctttcacaagcggtgtgattgttaagaaagtttacgaataaaactacaagcgttcataaagtgttctatattgctctgcagccttacgccagctgaagtcttgttccattgcatctgtacgaaccatcgcccatgcacgcggtttttgccataaggcaaaggcacgttgcaagcaatggcggagagcttcaggcgttgcactttcaaacacaaaacctgttgcggtgcgagctttgatgctttctgaagtgctatccaccaccgtatccgctaaaccacctgttttacgaacaagtggcagtgtgccatattgcaaaccataaagttgggttaagccacaaggctcgaaacgacttggcactaaaatcacatcgccacctgccaccattaaatgcgaaagggcttcatcgtagccgatttttaccgcaatattttgcggataacgttcagcaagctcacgaataccttgttcaaagtgcggtgcacctgaacctaaaatcatcaactgaccgccttgtttgacgatttcgtctgcactttcgattaataaatcaacacctttttgctcggttaaacgggtaaccatcacaaatgccaaggcagattcatcttgtggcaaattgaaataggcttgcagttcggctttgtttttctttttgcctgccatatatttgagcttgtaatggtgcggaatgtattgatccacgttcggatgccaaatattttcgtccacaccatttaaaatccccaccaaacgaccttgagcttttaagccagaaagcaagccttgcaaaccgtaggcaaattctggtgtcgtgatttcttctgcataagttgggctaactgccgtgcttgcatcagaatagaacaaacctgatttcaagtaagaaatctgcccaaataattccaagccttctacgtggaacatccctgtcggcaagccgatttcatacaaatgatgataagaaaactgcccttgatatgccaagttgtgaatggtgaacaccgatttcgcagggcgacctttgttgaacagatatgctgcacacaaacctgcgtgccaatcatgagcgtgtaccacttctgcacgccaccagctatctaaacctgtggctaattctgcccccacccaaccgagcaaagcaaaacgtttgtagttgtcgccgtagtcgttgtaataggcatcgtgataaggattgccttcgcgaccgtataagtgcggtgcgtcaatcaaatagatcccgacaccattatattctccataacgcaacaccacgtgcccagcgaagttgtcaaattcggcaaccacttgagtattctgaatgcctgctataattgcgggataagcaggcaataaaacgcgagcatctagcccaatttggttctgtgcttggggtaatgcccctaaaacatcggcaagcccgcctgtttttaagagcggatagagttccgaacaaacgtgtagtattttcattgagttttttattttccctataaatatgaataatgctcgatcagccccccctctttgctaaagagggattcagaaagtgcggttaattttgaccgcacttttcctaactaatctaaatgaccttcttcgccaatctcgtgtccctcaagtatctttagcattttcggggttacaagaatgactttgcctgttgagctaatacggaagcgatttttatcttcttccatatccacaccaatttgcataccatcaggaatttcgcattcgcggtcgataatacaatttttcaacacgcaatttttaccgattttaacttgtggtaacaccacgcagtgatcgacttttgaaaaggaatcaattttaatgcgatcaaaaagcacggaattgctgatcgatgcatcggtaatcacacagcccccgccaatcaatgagttatctactgggtgcacgttagagtgtttatagaagaatttagacggataagcctgaaccggattaccacgaattggccagctttggtcgtaaatatctaattgtggattttcagagactaagtcgatattagattgccagaagctatcaagtgtccctacatcacgccagtaaatttcgccctcggtgttgcgtcccatgcaagaacggctaaatgggtgagcataaagcgcgccttcttctaaacattttggcaatacatctttaccgaaatcgtggctggtgttcggggtgccaacttcacgatctaacattttgtaaagataatccgcatcaaacacataaatccccattgaagtaagcgaaacatcaggtttacccaccattgctggcggatcttttggtttttccacgaaagcttttactttcaagttttcgtttacagccattacgccaaattcgtgtgcttcagaacggggcacttcaatgcaaccaatagtacattttgccccactattgacgtgatccattaacatcacgctgtaatcttgtttgtaaatatggtcgcccgctaagatcaaaatatatttcgggcgatagtgatttttaataatagccatattttgatataccgcatccgccgtgccacgataccaagtagaatcgtcaatttgctgacgagctggcaacatatcgacaaattcccctctctcttgtggtaaaaaagaccatcctgtttgcaaatgacgaagcaaggagtgtgccgcatattgagtcacgaccccaattcggtttaaacctgagttaatacaattagaaagtgcgaaatcaataatgcgacgattaccaccaaaataaagcgctggttttgcacgtttatctgtcaattcgtgtaaacgtgaaccacgtccacctgcaagtacaagcaccaaagtgtttttaactaaatcatatttgttaaggtcgccagatttcataaggatctccatagtcttattgttattcgtcattcagcatacaaaagcccattgaactaagttcggcttgttcttcaagggttacattatgtgtgccgatttggggcttccatttcccattaggcaagtgaaacacctgaccttcggctttggcattaatcaacaaaagccaacgattgtctaaaaccacctgtaatgctttggtttgttgattttgccaatcttcaactgtcatcggttcgcctgcaatgttaagccattgcacattctcatccgaccaccattgatcttggtttaaactgcccattcttttgcggagtgcgatcgtttgcttggtcagttcaaataattcttcgttaaaatttgcccatttcagccaagtaatctcgttatcttggcaataagcattattgttaccatattgagtgttgccgaactcatcgcccgccaaaagcataggtgcgccattcgccagcaataaactcattaataatccactttgtgcaaaagtgcggttattttccaccgcacttttttgcggttcagaaagggattctgtagaaccttctactccgtggttgtaactgtaattttcgtttctgccgtcgtgattttcttcgccgttcgcttcattatgtttttggttgtaactcactaaatctttaagcgtaaaaccatcgtgagcggtaataaaattaagtgtagtatgtggcaagcggtcatttttcttaaataaatcgatagagcctgcaaaacgttctgcaaatgcaccgatttcgccacttttccatagccagaaacggcagagatcatcacggaatcggtcgttccattcggcaaaataacttgggaaattgccgacttgataaccgtaatgtccaatatcccaaggctcggcaatcaatttaatattttgtaaacttggctcattttttatgtcagtaaaaagctgagctgacgaattaaaatctggtgtatcacgaccaagcacggaggctaaatcaaaacggaaaccatcaatgtggcattgctccacccaataacgcaggcaatccaccacccactttcgccctacatcagaggataaattgagcatattgccgcagcctgtccaattgatataacgcccttgatcgttgcgccaatagtaagtttgatcatcaataccacgctggcagaatgttgggtaagtttgctctgattctgcagaatggttaaacaccacatctaagataacttcaataccctcattgtgaaacgcctttaccatcgctttaaattcagctaatggattatttgttgccgcatatttaggttccaccgcaaacatcgctaagggattgtatccccaataattttgtaagcctcgtgcctgtaagtgcggttcatttatatggaaatttacaggcagcaactccaccacagttacgcctaattctttcaaatacgccaaattcacaggatgtgctaatccagtataagtaccacgcaacgccgcagggattttctcgtttaactggctaaaccctttaacgtgtaattcatacacaatggtttcagcccaaggcgtattgggtaaagtatcattttcccaattaaaatcttccgaaatcacaaccgctcttggggcaagatgcgcgttgtcgcgattatccgaaagcaagaaccaagaacaactttcttcgctacttaaatcaggtttaccatttacggctttcgcatagggatcgagcattaatttattcgggttggcaaattcgccgtgaatacgaaatccatattccgtaccagttttcacgccagttaccgccaaatgccacacattttcagtacgcaccatcggcaagcgtgtttcttgattttgttcgtcaaaaaggcaaagttctacgcctattgccgcagcggaaaacagggcgaaattggtaatttgcacgttgttttcgaccgcttgtgagtatcccattggaataggattgccgttgttgtagattttgaacatatttttatcgcttttgtaggggcaaatgacatttgcccaaaaacatcggtggtttatcagggcgaatgtaattcgcccctacaatttatctattcggattatttcgccttcaatctcaaataaactgttgctaacggcggaatggacactgaaatcgaattttctcgtccgtggctttcgattttttcacttgcgacacaaccaaaattgcccacgtttgaaccttcgtaatacatcgaatcggtatttaaaatttcttcgtattttcctgcaacattcacgccgatgcggtaattgtggcgaggcacaggggtaaagttactgacgacaataatacgttctccgtttgaactgcgacgttcaaaggcgaacacagaatttgccgcatcatcaacgacaagccaatcgaaaccctctggggagttgtcgagctcaaagagcggtcgatttttttgataaatttgattgaggtctttaaccagcttcaatacgcctttgtgccaacctccgccaatattttcatcaagcaagaaccagtccaaactttcttcataattccactcacgaccttgggcaaattcattccccataaagagcaattttttgcctgggtagccccacatataaccgtaatatgcacgcaagttagcgaatttttgccacgtatcgcctggcatcttgccaagaagtgaatatttaccgtgaaccacttcatcgtgagaaagtggtagaacaaaattttcgctgtattgatataccattccaaaggtcattttgttgtgatgatattggcggtaaatggggtcaagcttcatataagccagtgtatcgttcatccagcccatattccatttgaaattgaagcccaagccgccgtcttcgcttgggtgggttacgcctgcaaaagaggtagattcctccgcaatagaaattgctcccgccatttcgctgtgaattttccagttggtgtgttttaaaaactcaatggcttctaaattttcacgtccgccgtattggtttggaatccactcgccctccgcacggctgtaatcgcggtagatcattgaagccacagcatccatgcgaataccatctacgccaaagcgttcaagccagtaaagggcattgctggacaggaaatttttcacttcgttgcgtccatagttataaatcaaggtattccaatcttgatgatagccttcgcgagggtcttcatgttcatacaaggctgtgccatcaaatgcgactaaaccatgggtatcacttgggaaatgccctggcacccaatctaaaatcacgttgatgcctgcttcgtgagcacgttttactaaacggcgaaatgcctcaggtgagccaaaacgactggttggcgaataaagcccaagtggttgatagccccaagaaccatcaaacggaaattcagaaagcggtaaaaattctatatgggtaaagcccatctcttttacataaggaattaattcatcagcaatttgatcgtaatctagccaaaaattgttttctaaattacgacgccaagatcctaaatgcacttcataaatagaaatcggttgatttgcttgatttgcttgacgacgttgttccgtcatttccaccacatttggtaatgcactaatttgtgaagctgtatcagggcgaagttgcgaactaaaggcataaggatccgctttcaaacgaagattgccatagcaatcaatcaattcaaatttatagagctgaccaaggctggctttcggcaggaataattcccacacaccgcttttcgggtggaaacgcatcgggtggcggcgaccatcccaatagttgaaatcgcctacaatagaaactcgtcttgcattaggtgcccacaagcggaaattcaccccgctcacaccatcacattccataaaatgtgcaccaagcacttcatatgggcgaagcatagatccttcagaaagtagccattgttctaaatcgtcaatcattggatgaaaacgataaggatcttcgataatttgtgcttcattaccccaaaaaacctgtaattgataagcaaaaaattgacgacaatttggaataacaccaacaaaaaatccacgctcatcgacacaatccagttccgttatttctttaccactttcacgctcaatcaccaccattcgattggcatctggcaataacgtacggatttcaattccttgctcggtttcgtgcataccaagcgtagcaaaaggatcaccattgctcgcatcaaaaaaaccatcaatagttgcttgtgttactgcggttgtcatatttactccttatacatttcgcccttggttaatttgcacaaagaacgtttttaaagcttcattgctaaaaataaacgctaacggttgagcaagtttcttgcaccagtttgggtattcatttgaggtgcccggtaaattagaactgatttcttggctaagtaaattttctaattgcacaccaatcaatcggctgttactttccgctaaataataatggatcattcgatttaaataatcgtgcatcgccatagaaagtgcatcaccttcataatgcggcggtaaataattatcacgatgtaaactatttaataaggcttgtttatccataacacgttgatcatatttttgcttgagcacttccccattcagaataccgagttgattaaataattctaaatcacggcaatgccaaaaactttgtaatgagggaacatcatgtgtaccaatagtggcataagcatttcgaggataatcagatatacgaggaaattcgccatttcgttgggcaaaatacaatacaaaataagagaaaatttgaaactcgtttaatttccaccgcacttcatcaggcacagtgccgagatcttcaccaataatcaaacattcattgcgtacactttcaatggcaagaatcgccattaattcatcaaaaggataatgcacataagcaccgtcagccgcggtttttccttttggaatccaccacaaacggaataagcccataacatgatcgatgcgtagcacaccgaaatattgcatattggcacgtagcatatcgataaatggtgtaaagccacgtgcttttagcactgttggattataaggtggcaaattccaattttgcccgactgggcctaacggatcaggtggcgcaccaatagaggcatttacacaatataaatcaggatcgctccatacatcagcactgccacgagaactatttacggctaaatcgccataaatacccaacttcatgccagactgtttacaaagattttgtaatgcggaaagttgttcttctgtaagccattgcaaccaagcaaaaaattggatttgctcatggtgtatttttaatagggcttttctttttgccgcacttaaatgctgccattccttacgccagccaagccaaccaatggtattttcttctgcttgatggtcagcgtgttcttgtaaatccaagacattaaataagccctgtaacaacaaaggttcccctttgctttttaaataatcagcaaagatttttcgacgtgtcacaatttcaacggattgactacgctgaaagaaataaaacagggactcaagtgcggttaattttaaagccaaaattgaagaataatcgacgcaatcactttcacgtaaagcagcaatttttgctttaatatcctcacgcttaaaccaattttgtactgaacggcaacgcttaaattcgggtaaatcaggaatgtccaaatataagaaattcaaccaacgacgagaggatgaactataaggactagcccaatttggcacagcaggatatggcaaatgtaatggattaattcccacataatccgccccttgttttgcactttgttcaatcaaagcagccaaatcgccaaaatcgccaatcccccagttttgttctgagcgtaaactgtaaagttgcacattcacgccccacacttttttattttttaatacggatggttgaaaagctgttttaggagaaataagtaaacgaacgcgatactgttcagtgtcagaaaaaatagataattgataatagccaaaaggaagtggaggcaaagaaagtgcggataaatttgaaagtattttttctaacagaatagcattagattcatcaatcagctgataacgatattccgcagatggtgggagatctagacgattgagtcgataatcaatcggttcattttcaaatgcagccagtacatcgtcaaactgtcctttcgcttttggcggaggctgcaaaagctcaacaaaagttaaaaccgtcttttcatccgcaaaaataagatgcccatcaatatcatagtgagaaagcgcgataccgcatttttctgctttttgtttgagagaatccgagatttgcatagacaccacatgacaactgtataactattgttagggattatagctaagctgaaattgatgacaactggctttatttaaaagtgtgatcttcgtcaataataaattcaaaccaatcaatcacatcgcgttcgtggataccatttttaatcaaaatatccgcattttttacagaatggggagagccagaaataagcggatgccattcaggtagtgtttttccttcataaagcaaacgataggcgcaagtatcaggcagccaatgaaaatcaggtaaattctttttggtgagtttggtgcaatcggtttcaatgttaaaacgctctgaataattaccgcactttcctgtttccacatctaaaagattacaagcaattcgggtgtaatagagtttttggcgtttacttcgcccttgaatatatttgcgataacagcatttgccgcagccatcacataaggcttcccattcagattcagtcatttcaagcagggattttgtttgccagaaattgggttcaagttgcatattggattgcatagttgatacaaataaaaagtgcggtcaaaatcacgtttgttttgaccgcacttggttgattaaaattagaagccttcttttaagcttactgttaagttaaataccaaatgttcaggtcggctatctttactatctgcacagaaataaccctcacgttcaaattggtagcctttctctgcttctgcatttgcgaggctttgctctacaaaaccttgttttatcactaaagaatttgggtttaacacgctttcgatatcatcttcagcccctggatttggcacagtaaataagcgatcatacaaacggaattcagctggatgattattaaccgcagaaacccaatgaatgacacctttcactttacgtccatctgctggatttttacctaaagtttcaggatcgtaagtacagaagatcgtggtgatttcaccatttgcatctttttctacacgttcagctttaatcacataagcattacgcaaacgcacttctttgcctaatactaagcgtttatattgtttgttcgcttcttcacggaagtcagctcgatcaatataaagttctttcgtgaacggcaattgacgttcccctaattcaggacgatttggatgatttggggcagttaaaaccgcttcgctttcaaaattttcaattaccacacgaacaggatcaatcactgccattgcgcgtggtgcattttcatttaaatcctcacgaatgcaggcttcaagtgctgaatactctacgacgttatcttgtttagtcacaccgatacgacgacaaaattcacgtaacgaagctggtgtataaccacgacggcgtaaacctgaaatggttggcatacgtggatcgttccaaccatccacgatttcatcatttaccaatttcaataatttacgtttagaggttaaagtgccttctaaattcaaacgtgagaattcatattgatgcggtaatggacgttcaatactgatattttccaacacccagtcatataaacgacggttatcttggaattctaatgtacagattgagtgtgtaatacgctcaatcgcatcagagatacagtgcgtgaaatcgtacattgggtaaatacaccatttgtcacctgtttggtgatggctggcaaatttaatacgataaattactggatcacgcatgaccataaatggcgaagccatatcaatttttgcacgtaaacttgctttaccctcggcaaattcgccatttttcattttttcaaataacgctaagttttcttcaatagtgcggtcacgatatgggctgtttttaccaggttcggttaaggtaccacgatattcacgcatttcatctggagaaagctcatcaacataagccaaaccttttttaattaattcagcggcatagccataaagcgcatcgaagtaatcagatgcataacgcggttcgccctcccatttaaaacctaaccattccacatccgctttgatagaatctacatattccacgtcttcttttactggattggtatcgtcaaaacgtaggttacataaaccttggtattcttttgccaagccaaaattcaagcaaatagactttgcgtgaccaatatgcaaataaccattcggctctggcggaaaacgggtatgaacgcttttatgtttacccgaagctaaatcttcatcaataatttgggtaataaaattatgagtgcgggtattttctgcacccaaagatgtctctgtatggctcatcattttctctcgttaaaataaaaaaatattcggctattctatacaaatctaagggaaaataaaggttcatctcctgttcttgccatagaaatactagatttaaataaaagattgtaaaaacttgccataaaaaaccgccacgaaattatcgtggcgatgtataaatgcacaaagtgcggtaagttttttgaatgtttagcttaccaaacccagccagctcccatttgataggaaattttgctgtttttgcctgcattcacggcgataccgctttttaatgtgatgtagtggagggaggcgtatcaactaaagctgcctaattttacgtcatatagataaaatataaaggaaatattgtttttataaataaaaagtgcggtgaaagtctcaaaaatttttaccgcactttattgaaatagagtttacattacaaccacatcaaactgttcttggttataaaactgttctgtttttacttttactcgttttccaataaacatttccacttctggcagtaaaccgtgagattcttcattaataagatattctgaaactgctggcgaggcataaacaacaaattgttcactactgaataaatgatacacccgaataatttcacgcataatttcgtagcaaactgtctcaacagttttcacccgaccacgtccatgacaagttggacattcatcgcatagcacgtgttcaaggctttcgcgggttcttttacgagtcatttctacaaggcctaattgcgtaaagccattcacattagttttcatacgatctttagaaagcgcatcacataaagattgcaatactcgattgcgatgttcatctgtttgcatatcaataaaatcaataatgattatgccaccaagattacgtagttggagttgctgcgcaatggctttagttgcttcaatattggtattgaagatggtttcttctagattacgatgccccacaaatgcgcctgtattaatatcaatggtggtcatggcttctgtttgctcgataattaaatagccgcccgatttgagattaacacgtttatctaaggctgtttggatcgcattttcaaccccgtacacatcaaagataggttgattgccagaataaagaacaagtttatcgcttaattcaggcataaattcatcggtaaactcttttacttcgccaaagcaaagtttagagtcgatacgaattttttctaagtttgtgccgataaaatcgcgcaaaatacgttgtggaagtgctggctcgccgtaaatttttgatttggttgggtacttagatttacgttctaaaactttacgccataagcgttttaaaaattcagcgtcttgacgtaattcttcttcgcttgccccttctgtggcggtacgaataataaaaccgccgagttcatcacaaaaaggttcaactaatgcttttaaacgggcgcgttcttcttcgctttcaatgcgttgtgaaacgcctacgtggctattttcaggcataaaaacaagatgacgcgatggcaatgtgatatccgttgttaaacgtgcaccttttgtacctagcggctctttcaccacttgtacaacaatatcctgcccttctcgtactaattctgaaatgctcttaactttaaattgcttttgttcattttcatctacacattctgtatgggatacaatgtccgcagcgtgtaaaaaagccgctttttccaaaccaatatcaacaaaagccgactgcattcctggtaacactcgagtgacacgacctttataaatgtttccgacaattcctcgtttagcttggcgttcaatatgcacttcgcgcaacattcctgtttctactagcgcaatgcgtgtttcgttaggcgttacgttcatcaataactcgacagcatccattttatattcctaatttcttaaatttcatcaaatatttagtctaaatagaataatagcccgaaataaggtaaaatgcaccctttctgaaatttttaacccattttggacttatataatgtttggattcgacccaagtcttattacttttactatttatattttcgggatgttgctgattggcgtactcgcctattattacacgaataatttatcagattacattctcggtggacgtcgtttaggcagttttgttactgcaatgtctgcaggtgcgtcagatatgtctggttggcttttaatgggcttacctggtgcggtatatttatcaggcttagttgaaggctggattgctattggtttaactatcggggcttattttaactggcttttagtggctggtcgtttgcgtgtttatacagaattaaataataatgcgctcactctcccagaatattttcacaatcgttttggttcatcacacaaattattaaaacttgtttctgccactattattttagtgttttttactatttattgtgcttctggtgtcgtggctggcgcaaaattattccaaaatatattttctgtggaatattccaccgcactttggtacggcgcagcggcaaccattgcttacacgttcatcggaggtttccttgcggtaagctggacagataccattcaagccacattaatgatttttgcattaattttaacccctgtttttgtgttattgagtttcgccgataccgctcaattttccgcagtactagaacaagctgaggctgccgtaaataaagatttcacggatttatttacttctaccacaccacttggtttattaagtcttgcggcttggggattaggctatttcgggcaaccgcatattttagcacgctttatggctgcggattctgtcaaatcacttatcaaagcacgccgtattagtatgggttggatggtgctttgcttagcaggcgcaattggcattggcttattcgctattccgtatttctttgccaatccagctattgcaggcacagtcaataatgaaccagagcaagtatttattgaattagctaaacttttatttaatccttggatcgcgggcatattactttccgctattttagccgctgtaatgagtacattaagtgctcaattattaatttcttcaagctcaatcacagaagatttctacaaaggttttattcgccctaaggcttcagaaaaagagctcgtatggcttggcagaataatggtgttagttattgccgcacttgctatctggatcgcacaagatgaaaacagcaaagtattaaaacttgtagaatttgcttgggctggttttggtagtgcgtttggccctgtggtacttttctctcttttctggaaacgaatgacatcatcgggcgcaatggccggtatgcttgtaggcgcagtgacagtatttgcttggaaagaagttgttccagctgatactgattggtttaaagtatatgaaatgatcccaggctttgctttcgccagccttgcaattattgttatttcattactttccaataaaccagaacaagatattcttaatacctttgataaagcagaaaaggcttataaggaagcaaaatgatcgactttcgccctttttatcaacaaattgctactacaaatttatcggactggttagaaaccttaccactccaattgaaagaatgggaaactcaaactcatggcgattatgcgaaatggagcaaaattgttgattttctaccagatttacatgctgatgaaatcgatctaaaaagtgcggtgaaatctgaccgcacttttcccctttcagaaggtgaaaaacaacgaattatccatcatttaaaacaattaatgccgtggcgaaaaggaccttatcatcttttcggcattcatgtagattgtgaatggcgttcagattttaaatgggatcgtgttcttcctcatttagctccactgcaaggtcgcactattttagatgtgggctgtggcagcggttatcatatgtggagaatggtaggtgaaggcgcaaaaatggtggtagggattgatcctaccgagcttttcctttgccaatttgaagctgtacgcaaactgcttaataatgatcgtcgagcaaatcttatcccacttggtattgagcaaatgcaaccattagcggcatttgacactgtattttcaatgggcgtactctatcatcgtaaatccccattagatcatttaagccaattgaaaaatcaattggtaaaaggtggtgaattggtattagaaacattagtggtggatggcgatgtaaatactgtgctcataccagcagatcgctatgcgaaaatgaaaaatgtttattttatcccctctgtcgccgcactaattaactggctagaaaaagttggctttaccaacgtacgttgtgtggatgtagcgacaactacattagaagaacagcgtaaaactgattggttggaaaatgaaagcctgattgattttttagattcaaatgatcacagtaaaaccattgaaggctatcaagcaccgaaaagagcggtaattttagcaaataaataaaaaaggaaattatttcctttttattttactcgcgtttcatatttacaaagaataatactctaattctactgaagttaatgtggataataaggtttcagccatcgttttatggctcaattttaatgctttttcagccatcacaattcgctcaatatcactcaattttttatcatttaaatacgcaaaattaagtgcggtttgcaacgctggcaaactcggattaaatgcggcgttttctgcataacgtcctgtcaccacatcaccatttttaaataaaatcgcaatgccgtgcggactatttgaataaggacaatgagattgatttgccgctaaaatagcttgattaaccaaatcatcttgatgatcagcaactaaatcatgattttcttccgccaaaagatgcgctgcaatatcgagatcttttggcccaaacgcatccggtaaataagaatgtaatggattattttggctatgcggcaaatgaattgaaattttttcagcaccgtgcaattcattcataaattgacgacaatgtccgcacggcgtgtaattgaccaccatatctgaaatacggcgttcattacgcaaccaagcgtgagaaattgcactttgttccgcgtgaatcgtttgctgaatggctgaattagcaaattcttgattcgcgccgaaataaaaatccccttgttcgccaatagcaattgcccccacattaaaatgagaaatagcagtatgactataacttgcagcaagtggcaacaagtgcatagccaattttagtggggtaagttcaaaattatgacaaagctgctgcacttgggaataatttaaaaaaccagcccaattttgtgaacgaagttcattcacaatagcttgattaagtgcatcatcttgtggcaaggtgcgcttaataagttcttgcataacatatccttagaaaaaatattaaaaattataactgtacttattaaatcaaaatttattgttagctgcgatagtttgattaaatattcattaaaattgtgatcttgatcacttatttgatagcttctatttattacaatttcttaacaaataagactaaggctatcaattatattgaatagaacaatttcacttcaaattatagaaaggtataatacccatatcaaagggagggcattagctcaattattcaactagaaaaaggaaattattatgtcaaaaacatcaatcggactagataaagttcaatcagcagaattagccgataaacttaacgaattacttgcaacctaccaagttttctatactaatgtgcggggctaccactggaacattaaaggcgtaaacttctttgcattacacgcaaaatttgaagaaatttatactaatttagttgctagagtagatgaggtggctgaacgtattttaactttaggttacacaccaaataatgcttacagccaatacttaaaaatatctcgaattaaagaagatattgcagtaagtgaggcacaagaatgtttatcaggcacattacaaggtctaaaaacattactagatcaacaacgtgaaattcttgcttttgcaaataacgctaatgatgaaggtactgcatcacaaatgagtgactatattaaagaacaagaaaaattagtatggatgttccaagcagcgtgccaaacttgccataattaatgaataaatttcaacgctaacgaaaactaacctgcaattaatctaactcaataaagttagattaatttaatttgtctaagattaaatttgatccagcaaattacctcaaaagtaagagtttcctatttagaataagaatgtcaaattcagtctgaataaaggaaactcttatacctattattcacagtgatctctttaaactaatttagttaatttagccactaaatttaacgttttttaaatcagtaaataaatctatagaaataaatattgtagagcgttaaaaattttgattattaactatttttttagttgataaaatatattcttgagaatttagagttaaattaataggataaaaaataatttaaaatgaagaaatattaaatttgttagctattttattatttcttgtccaattagataaaaaaagcccctaaataattaggggcattaaaaaggaatttatgaataaaatctctaaagtttagcttcatcaaaggaatctcgataaaacgccaccattatattgagtaatctaaagaatagcaagaaaaatctttacatttctttacaaatctttacatttcagcatttcgataattacttggacagtattttccatgccttgtaaagaaaccaactcgtgtttactatggaaattatagccgccagtaaaaatatttgggcatgctaaacctttagaggctaaaaatgccccatctgtaccgcctcgaatcggcttatgatttggtttaattcccaccgctttcattgcgcgatcagcaagttcaattgattgaggaacgttttttaccacatcatacatattttggtagctatcttgaatttctaactctataggctttttcaaaccttttttagcattaaatttttccacctgatttttaataaaagcttttctttgtgcgaaattctgttcgtcaaaatcacgaatcaaataggtaagctctacttgctcaatatcgccagaaaaatcttctaaatgataaaagcccgctttcccatcggttttttctggtacttcatcaacaggaaaaacttgctgaaattcacaagctaaagtcagcgcattcagcatttttccttttgcataacctgtgtgaatatttcgcccgaaaaaccgcacttttgccgttgcagcattaaagttttcgtattctaattcccctacctctcccccatcaatggtatatgcccaatcacaggaaaacttttccattgggaaataatggattcccaaaccaatttcttcatcaggcgtaaaagcaacacgaatattgcaatggggaatattctctttttgaagaatggaaagtgcggtcataatttctgcaattcctgccttattatccgccccaagcaaagtggttccatcagtaacaataagcgtttgtccgactaatttttgcataaaagaataataaacagggctaataaattcctcgccaatacctaatgcaatatctccgccacgatattcttctatcacttctggacgtacatttttaccactacattgcggagatgtatcaagatgcgcaactaaaccaatggttttcgttaagttaggatcattagcgggtaaaaatgctgttaccactgcatatttacttacttcaacattctccaaaccaagttggattaattctttttgtaactgcatggctaacttcatttgcccaacagagctgggggaatgcttcgcattaggttttgattgggtgtgaaaagacacataatgtaaaaatcgttctaaaagttctgctttatctatttgagaaatcatattctcgctccttttaaaaatatcttttttagtttaacgagaaaaatagaaaacatcttgatatataacaatatttataaaattaacgaagtaaaattcatcgaaagtgcggttaaatttctcgttatttttatgaacggcagtttttttactttctaaggtattaagtccttttcattattaacaattcactatatcataggcgtctatttttatatgtcgcccctgcagtcttgcaggttttatttctactcagtaccaaatcattggtgaaattagggagaaaaccaaagctagtggaaaatcagcctcaaaacaagcctattattgagcttcgttcaatcaaaaaatcctatggttctaacaccattattaacgatttcaatcttgcaattaataacggtgagtttgtcactattcttggcccttcaggctgtggtaagaccacagttttacgcttacttgcaggcttagaagaattggattcaggtagcattattttagatggtgaagatatcaccaatgtgccagcggaaaaacgtcatattaatacggtattccaaagctatgcgctatttccacatatgacaatttttgagaacgtggctttcggtttgcgtatgcaaaaagtaccaaacgaggaaattaaaccgcgtgttttagaagccttgcgtatggtacaactagaagaaatggctgatcgtaagccaactcaactttctggcggacaacaacaacgtattgctatcgctcgtgccgtagtaaataaaccaaaagtgttgttacttgatgagtctttatctgcattggattacaaattgcgtaaacaaatgcaacaagaactcaaaatgttacaacgtcagcttggcattacctttatttttgtcacccacgatcaagaagaagcgattacaatgtctgatcgtattgtattattgcgtaaaggtaaaatcgcacaggatggttctccacgtgaaatctatgaagatccagctaacttattcgttgctcgtttcattggcgaaattaacgtatttgaagccactgtgattgaacgaaaatcagaacaagttgtactggcaaatgttgaaggtcgtatttgtgatatttatacggatatgcctgtggaaaaagatcaaaaacttcaagtactccttcgccctgaagatattgtgattgaagaattagatgaaaatgaacattctaaagcaattatcggtcatattattgaccgcacttataaaggaatgacattagaatcaacggtagagtttgatcataacggaatgcgtgtccttgtaagtgaattctttaatgaagatgatccacatatggatcatagcataggacaacgcgtaggtatcacatggcacgaaggctgggaggttgtactcaacgatgaagataatcaataataaattccagaaaattactgttgcgattatcttcagttggctaatcttctttgtgctgattccaaacttattggtacttgccgtaagttttctgactcgagatggtagcaacttttatgcattcccaattactattgaaaactatacaaacttgtttaatccgctttatgcacaagttgtgtggaattcattgtctatgtcgggcatcgccaccattatttgcttactaataggttatccatttgcttttatgatgagtaaaattcatcctaaatatcgaccgctcttattgttccttgtggttttaccattttggacaaactcgttaattcgtatttatggaatgaaagtgtttcttggcgtgaaaggcatacttaacacgatgttaattgatatgggaattttgagtgcgccaattcgtattttgaataccgaaattgcggtaatcattggcttagtttatttactattgccatttatgattttgccactctactctgccattgaaaaactagataatcgtttattagaagcagcacgagatttaggagcaaatacgttccaacgtttcttccgagtgattttaccattgactatgcctggtattatcgcaggttgtttattggtattattgccagcaatgggaatgttttatgtagcagacctactcggtggagcaaaagtcttgcttgttggtaacgtaattaagagcgaattcttaatttctcgtaactggccatttggttctgcagtcagtattggtttaactgttctaatggcattgttgattttcgtgtactaccgcgcgaataaactattgaataagaaagtggagttagaataatgagtcgtttactacgtaatgcatttatgtttgtggtatacgcttatttgtatatcccaattattattttagtcactaattcctttaacaaagatcgttatggtttgagttggaaaggttttagctggaactggtacgagcgtttatttaataacgacaccttaatacaagctgcgattcattcggtaactattgcattttttgcggctaccctagctactattgtaggtggattaactgcaatcgcactttatcgctatcgattccgcggtaaacaagcagtaagcggtatgctatttatcgttatgatgtctccagatattgtaatggcagtatctttacttgcattatttatggttgtgggtatttcattgggcttctggtctttactacttgcccacgtaactttctgtttaccgtatgtgaccgtaactatcttctctcgcttaaatggctttgattccagaatgtagaagcggcgaaagacttaggtgcaagcgaagtgactattttacgtaaaattatccttcctttagcattacctgcagttgtatctggttggttattaagtttcactatttcattagatgatgttgtggtttcatcatttgtcagcggtgtaagttatgaaatcttaccattgagaatattctctctagtgaaaactggtgtaacacctgaagttaatgctttagcaacgattatgatcgtgctttcattagctcttgtcgttttaagccagctaattacacgaaaaaataaccattaattaacaaaaggtttcacaaacctttgaatttaaaatagaatacgccttgacgcacaatcaaggcgtttttttatgcctgtcattcggcaggtggtttttttacgactctttaacaggagaacaaacaaaaatgaaaaaatttgcaggtttaattactgccagcttcgtagctgcaactttaaccgcttgcaacgataaagatgctaagcaagaaactgcaaaagctacggctgctgctaatgacactgtgtatctctacacttggactgaatatgtaccagatggtcttttagatgagtttactaaagaaactggcatcaaagttatcgtttcaagcctagaatcaaacgaaacaatgtacgctaaactcaaaactcaaggcgagtctggtggctatgatgttatcgcaccttctaactacttcgtttctaaaatggcacgcgaaggaatgttaaaagaacttgatcacagcaaattacctgttcttaaagaattagatcctgattggctcaataaaccttatgataaaggtaacaaatactctcttccgcaacttttaggtgcgccgggtatcgcattcaataccaacacttacaaaggcgaacaattcacttcttgggcagacttatggaaacctgaatttgcaaacaaagttcagttattagacgatgcgcgcgaagtattcaacatcgctttattgaaaattggtcaagatccaaatactcaagatccagccattatcaaacaagcctatgaagaattattgaaattacgtccaaatgtactttctttcaattccgataacccagctaactcgttcatctcaggcgaagtggaagtgggtcaattatggaatggttcggtacgtattgctaaaaaagaaaaagcacctttaaatatggtattcccaaaagagggtcctgtactttgggttgatacacttgcaattcctgtaacagctaaaaatcctgaaggcgcacacaagctgattaactacatgttagggaaaaaaacagctgaaaaattaaccttagctatcggttacccaacctcaaatattgaagcgaaaaaagcattaccaaaagaaatcactgaagatccagcgatttatccgtcagctgatatattaaaaaatagtcactggcaagatgacgttggcgatgcaattcaattctatgaacaatattatcaagaattaaaagcagcaaaataattggtcaattagcaaagaattaaaatctgattctgtgcaatatttcctctaaataaaaacgccctttcgggcgttattttttaagctttaccgtcagccaaatttttcttttcttctaattcttcccagcgtaaaaatgctgtttctaattcggcttcagtatctgccaatgcttttaatttagcgtcggtaatatcgtgagcttgttggaaaaatgctggatcggctatttcagcttgaagtacggtgattttagtttccaactcttccaatagttgtggaagttgttctagttctcgttgttctttataagaaagtttcacggatttcggcttagaagtgcggtcatttttcaccgcactttcttcttttagtggttcagatttcttcgccttagcctgttcttccaccgctttgcttgcccaaaaattggcttgttgctgtttcgcatcaaagaatcctcccacatacttattcaaatgcccttcaccttcgaataaataacattctgtcgcagtattatcgataaattgacggtcatggctcacaattaacaatgtgccttgataatccgtcaaaatttcttctaaaagctccaatgtttctacatcaaggtcattggttggttcgtcaagaatcaataaattatttggttggagcaacaattttgcgagtaataaacgatttcgttctccccccgataaggctttaactggggtcattgctcgttttggtgggaacaagaactcttgcaaataccctagcacatggcgttttacaccattgacttcaatatcttgtttgccatccgccacattatccattacagttttttcaggatctaaatcagcacggtattggtcaaaataagcaatatctaatttagtaccacaacggattttgcctgatgttggctgaatttcacccagcaataatttaatgaacgtggttttcccacagccatttggcccaacaagcgcaattttgtctccacgtaaaatcgttgttgaaaaatcttttaacaaggtttttcctgcgatttcatagctcacatcttccatttcaaagacaattttgccagaacgacttgaggtatctaactgtaatttggctattcccattacatcacggcgttggcggcgttcctcacgcatcgcttttaatgcgcgcactcgcccttcatttcttgtacggcgagccttgataccttggcgaatccatacttcttcctgtgcaagtcgtttatcaaataattcattttgcaaggcttcaacgcgtagattttcttctttcgtggttaaatataaatcgtaattgcctagataagactgcaattgaccgcgatctaaatccacaatgcgtgttgccattttgcgaataaaagaacggtcatgggaaataaatacaaggctaccttggaaatccagtaagaaattttccagccattcaatagcttccacatctaagtggttggttggttcatcaagtaataacacatcaggatcgcataccaatgcgcgtgcgagagccgctttgcgtaaccaaccgcccgaaagtgcggataattttgtgtttggattcaaacctagttttaacaacacttcattgattttattttcaaatcgccagccatcagcgtgttctaatttatcctgaacttgctctaattgacttaaaatttgatcactgtaattttcttccaattgaacagaaatctgatgatattctttcaataaatccgttaaatgcccgacaccttccgcgacataatcaaaaatattgccttgcgcattacgcggtgggtcttgttctaaacgagaaaccacaagatctttttcgtattggattttgccatcatccataagcacatcgcctgcgatgattttcaataaagttgatttacctgcgccgttacgcccaactaaacaaacacgttcattcggttcaatatgtagttctgcgtgatccaacaaaggtgcatcactaaaggaaaggtatccattggttaaactaattaatgccacagctgccccataaaaattcagtgaaaattaaccgcactattctatacggtttgcataaaaaatcccatcaattcaatgggattctctcttaaatcaaagttgttgatatacccgcaatgcgtgtgcatctgacatgcctgcaatataatcgcaaataattcgcttcttcccttcttttggtgcattacgccaacgattttctgtatttcttggtaataaacgctccggatcagattcaaaaatctggaacatttctgttagcattctctgccctttatattcgattcgttgggtatccacattgcgaataacataatcccaaacgaattttttaaatacaccaagcgcagcaatcacttcaggtggcaactctgcgttataacgtaacaaaggttcatcaaaatttgccgttaatttccaccgcacattagtaataaaaaagttcaccaatgcaccaatcgcctgtttgcgctcaaaatgtttatccgagaaaagtcgttggctaattgaatcaatattttcatgtaaccaagctgacggaatttgtttcaatgcaacatgtgccgcttgccattgatgaggatttaccacgccagttacaatcgcatcttctaaatcatgtacgccataggcaatatcatccgccaattccataatgctgcaatccagtgatttaaaccgagtatgtaaagattcagctggattttcccgcacttttttaaattgacagaataaagtgcggtcattttcagaaagattttccagcaaccaattaaacatttttaaatcatcgcggaaaatgccttttcctggaatccaatcatgaatacgcacaaaacgaggatcaatgttgcgagaaaaattaagttctgcatattgaggcgaagccacacctaacaacgcgggatatttcactacacccaatagtgttcggcgcgttagattcatccctgcattttcagtgtaaggctcaagtttcgttaaaattctaaaggtttgtgcattgccttcaaaccctccctgctctgccatcatataatttaatgccgtttcgccaccatgcccaaaaggcggatgcccaatatcatgagcaaaacacaaactctcaataagatcgttactcggcaataaaggttttaattgtttttgcaactcgtttttatcaatatttaatgtttgcgaaaggctttcaaaggtttctaaaaatttaagctgtgcaacgaggctgctgccaatctgtgcaacttctaaagagtgagttaagcgagtacggtaaaaatcattttcgccaattgcgtgaatttgggttttcgcttgtaagcaacgaaaagcggcagaatgtaaaattcgcccacgatcccgacgaaatggtgggcgattatctttttcgcgtggaggatcaggaagaaaacgttctgtccaagaagaatcaatgataagtggtttcatatcgctttgttttatttcgtttttctgcattatctaatcatttagcgcaaaaaacaaccgcactttatctataacaaacaaaatctagaatgaataaagtgcggttgaatttttattgatatttaaacaaagaaataaatcagcttaaatacaaatggcgcgagaatagaactaataatcccacaaagcacaagagaaatagaactgtaacttcccgctgttggattcgtttccatacaacttactgtaccgagcgcgtgagaaaccgaaccaacagaaagcccaatagcttcttgatgtttaacacccaatttttttaatacaagataaccaaatatcgatccttgcaaacctgcaaccacaacaccaactgcagttacggcaggaatgccgcctaaatgacgggaaacttccatcgcaataggcattgtgatggatttaggtaaaaccgtagcgaccatttcgggcgttgcacctaaaagaaatgctaaaagcccgccacttaacatcgccaaaaaagaggctataaccaccgttgaaagaataattttccattgtctggcaatttggcgaagttgttcataaagaggcaatgcgagagcaacgatactcaagccaagtaaattattaataggcgcatttcctgccatataatcatcataaggaatctttcctatcactaaaatcgccgccaaaattaatactgttaaaacaaaagtattaaaaatcattgacttccaacgtttgctaatttgtagtgcgagccaaaacccgaaaattgttaaaaatgtataaagataaataatgtactgctgcatataaactttcctaacatactaattcgcttgttttacctgattttctctacgttttattacttttttgcgtttatgtgtaaaagattgcatctgatacaaataatgacctaaaaatcctataacaagtaaagtgacacaagtactcacaatattaggaacaagcaaaatattaatttgctctatcaataaatcagaatatttgataattcccacgctcactggtacaaaaagtaccgccataaaacgaattagcaaacttgcgcctaaataaatccaatttaaatgaatcactcgtgttgttaaacctaaaaagagcaataacaatccccaaatacttcctggaacacctgatggaatgtaataagcaataagatttccgagatataacataatagataaaatgaccaacgaacgaactaataaaaataatttttgaatcatatacaaccttttcaactattttcataatatttcaaaattattttacgcttttttttgctaacttgagccattttttcggtaaaataaccagacttagatcaaaaactttgcaaaatgataaatcgaaaaatactattggcgagtttattacttatttttaccgtactttctgcttgttctcgcgaaaaaaatacgtgtcgtgtggttaaaattagtgatggcgatacgctcacttgcctcactaaaggcaataaatccattaaagttcgtttagccgaaattgatgcgccagaaaaatctcaagcctttgggcaaaaatcgaaaaaaaccttgtctgatctggtttatcaaaaaaacgtacgtctttcactaaaaggaaaagatcgctatcaacgaaccttcgcgattgtttattatcaagataaaaatattaatttagaaatggttaaacagggtatggcatgggcttataaacaatattcccatgatccgatttatcttcaagcgcaagaaaatgcacaagccaaaggaattggtctttgggcagataataatccgattgaaccaagtcaatggcgcagacaagagaaaaattaatatggcttttgattatcaaacgttccgtcaagaatttccctatttccaacgtgaagattctgttatttatttagataacgccgccaccgcgttaaaacctcaagtgttaattgatcgcaccgctgaattttatgcgtctgcaggttcggtgcatcgcagccaatatgatgctgcccaaactgtgcaatatgaacaggctcgcacacaggttaaagaatgggttcatgcagaagataaacacgctgttatttggacttcgggtacaactcacgcaataaacttagtggcaaatggattgctgccgcaattaaacgccgaagatgaaattctgattagccaagcagatcatcatgccaattttgtcacttggcatgaaacggcgaaaaagtgcggtgcaaaaattcgagttttaccgattttagataattggctaattgatgaaaatgtgcttatttctaccctttctgaaaaaacaaaactcgttgcgctgaattttgtttcaaatgtcacgggcacagaacagccgattaaacgcctgattcaacttattagaaaacatagtcatgcgttggttttagtggatgcagcacaagcgattagtcatattaaaattgatttacaagatttagatgccgatttcctcgcattttctgcccataaaatttatggcccaaatggacttggcgttttaacaggaaaattgaccgcactttctcaacttcaaccgctcttttttggcggaaaaatggttgaacgtgtgtcaaataatcgtattacttttgccgaattgccttatcgtttagaagctggcacacccaatattgctggggttattggctttaatgctgtgctggattggctacaaaaatgggattttaccgcagcagaacagtacgctatatccttggctgaatccgtcaaagtgcggttaaaatcttacgagaattgccgattattcaattctcctcaagcaagcactgtcgtttgctttgtatttgacggcattgactgttctgatctttctacacttttgagcgaacaaaatattgcgcttcgtgtgggcgaacattgcgcccagccttatttagcacgcttaggcgaacgcaccacattgcgtctttcttttgcgccttataatacgcaaaaagatgtagaggcattctttaccgccttagataaagcactggatttattacaatgatagaacaattaaaacaagctaaaaattgggaagatcgctatcgcctgattattcaagcaggcaaaaatttacctcgcccaagcgataatgaactcgctcaaatgcaacctattactggctgcgaagcacaaatgtggtttcaaattatgcctaaacatgaccgcacttttcaattcagcggatttagcgaagccagaattatgaatggcttgctttggattttattcaatcaaatcaatggcaaaacagcggatgaattgaatacatttgatattattgccttttttagcgaactcggcatttcacaacgtttaagtgaaatgcgtttaaacggcttaaaccaaatcagacagcaattaaaaaatttatgtatttaatcgaaacctattttcgcctgactgcactcgaaaataatattgaatcacaaagtcgtttactcaatgcagtgatcgatcaatggcggtataacgggcaaattatcggacgtgaaattcctttatatttagcggaagaagatggtgcacaaggttttgctatgcgtgtcatttgccctgagcaagatagtcttttcccacaaaataataacgcagaagtgaatcgtgcattacaagaagcagaaaagtgcggtgtaatttttgatggttttcaacttgtgggcgatgatttcaattcagatcaaacagcagaaaatacatcgccagcttggcaagtgctttacacaacccatttacaaagttgctcgccgattcatagtggagaaaatttcgcaccaattccgttgtataaacagttgaaaaatcaaccgcacttaagccaagatctgattaaatggcaagaaaattggcaagcctgcgatcaactacaaatgaatggtgcggtattagaacaacaatctttggcagaaatttcggagcaccaaagcacactttcaaaacacggacgatatttagctcaagaaatagaaaaagaaactggcataccgacttactattatttatatcgtgtaggtgggcaatctttaaaatctgaaaaatcccgttgctgcccttcttgtggtgcaaattgggcgttaaaaaacgcgatttttgatacctttcattttaaatgcgatacctgtcgattcgtttcgaatctatcgtggaatttttttgtaattaatttataaagtgtcgaaatttgcaaaagtcgaacacctaatcggagaaaagatgaattaccaagacaacagcttaaaatccttaaaactcggtcaaaaaacggaatacgcctctcaatatgaccgcactttattacagcctgtgccacgtgcgttaaatcgtgatggattaggcattactcaaaaccaaccatttactatcggcgccgatatttggacggcttatgaaatctcgtggctcaacgaaaaaggcttaccgcaagtggctatcgcagatatttatctggattatcaaagccaaaatttgattgaatcaaaaagttttaaactttatttaaatagctttaaccaaagcaaatttaccgacttcaacgccgttcaacaaactatgcaacgcgatttaatcgaatgtgcgcaaggcgatgtaaaagtgcggttaaatccagtggcagtttatgatgctcaaaaaattgagcatttacaaggcgattgcattgatgaacaagatattgaaattactagctacgaatttaacgctaattggctgaaagattgcgtatcggatgaaattgtcgaagaaaaattagtcagccatttattgaaatctaactgcctcattaccaatcagccagactggggcaccttgcatattcactatgttggtaaaaaaatcaatcacgaaaaattattgcgttacgttatatcgttccgtcagcataatgaattccacgaacaatgtgtcgaacgtattttttgcgatttaatgcactacgcaaaaccagaaaaactcaccgtttacgcacgctatactcgtcgtggcggattagacattaatccattccgctctaattttgagaatttacctgaaaatttaagattggcgagacagtaaaaaactgcggtgaaatttcaccgcacttttctctacccttgtttcaaatcatttgcctgctgtaatagctgacggctttcttttaagaattgttcagaataatcgccaaaccagtcacgcaccttgtggaaagcatcaataaaaccttgacgatcattcttttcaaagaaagttaaggcttcgtcgtaagtttgttttagcgtttcaattaccgctaaattttctggcttatccataataatatctgcgtaaagctctgcatcttgcgcaaataagcgaccgatcatcgcaagttctaagcgataaataggagaagaaagcgccaataaattagcgagattaatgggctgtttggaaaggtgtaaaccattcgcaaaagtcgaaaaatggcgcaaggcttgtatataagtcatattgtgatcgtgttctgtggcattggtttgataaatttttgcgccccaaatttgaatttgctcaagtaaccattcataacgttcaggaaaacgtccatcacaacgtacaaccacttgttttgccatacttgcaatgtctgcaccaaacattggatgtaaacctaaaactgcaccagaatgaacttcaagcattttcgctagcggttcacgcttaacagaagttaaatctgcaagcaacatattttctgttaaataaggttttagtcgctcaatcgtttccaaagtaatattgatggggacggaaacgatcacgacatcagcattcgctaaaatactttcagccaccgcccaatcttcgcgatctaaaatagaaattggatagccagatgcacgtaaataacgggcaaataagccacctaatttaccataaccgcccacgataacaattttgtgaatatcagaattgatagttttaaaaccaaattggttttcattggcataggattcacgcataaaacggcgtagaacatcttcaattaaatcggctgaaatgcctgctttttcagcctctaaacgacgtgcttggagcattgctatttcacgctctggcgcataaataggtaatccatgttgatgtttcactttaccgacttgagaaaccaactcaagacgtttagcaaaaagttggataagttcgcgatcaagcgaatcaatttcagaacgtaaatctttaaggacttccataaaacccacctgcaaaatttagtttacatatattgtaaaaaattaattacagatgagattactagaattttataagaaaggcaatgaagttatgcagattgtgtaattaaccgttgtgggcgaataatattcccgtcgattaatgccacgcctaagaataaattctccgctgaaaataaccgcacttggccacctaattgctgttcattagcaaatttcactcgctgaccaaaaccaatggctttactctgctctacatccaaatgcaaagcgggcaatttacttactgcggtatcggttggcagtaatagacgatctaattcacttaatggaaaactttcagcgagcagttgtaactcattgattggtatcatttctgctacggggtaatccgctacggctgtacggcgtaacattgtcacatgtgcgccacaacctagcacttcacccaaatcatcgactaaggtgcgaatataagtgccttttgaacaatgtacttctaaggttaaaaaaggtgcgtgatattcaataaaattaagttcaaaaatcgtaattggacgtgcctcacgctcaaccgtaataccttgacgcgcatattcataaagcggtttaccgttatgttttagtgcggaaaacatggtcggcacttgcaaaatatcgccacgaaattgttcaagtgcggtcaaaatttgcggagtttcaacatgaacttcacgagtttccacgacttgcccttccgcatcggaagtatcggtacgttcgcctaattttgccgtaacaagataacgcttatcggcatcaagcaaaaattgtgaaaacttagttgcttcacccaagcaaattggcaacattcccgtagccaacggatcgagcgcacctgtatgccctgctttattcgcttgaaataaacgcttcaccttttgcataatgtcatttgatgacataccttgtggtttatccaacaaaaacacaccatcaacatcacgccagcgtttacgaggtctagacattagttgctttcctcaacgtgttttttctcatcttcacgcacaacatttgtcacaagatttgacatacgcatcccttccactaaggattgatcataaataaagcgaatctctggcacgatacgtaaacgcatcgctttgcctagtaatgaacgaatataaggcgatgctttttctaagcctttcatgccttgctcaattgccgtttcatcgtgatcgaataaaaaagtcacaaagatttttgcgtaagataaatcgctcgacacttccacatcagaaaccgtcaccatcccaatacggggatctttcacttcgcgttgtaaaatgactgctatttctttttgtatttcttgagcgacgcgatcgctacgtttaaattctcttgccatagttattccttatttataaaagcacctcattctactggaaatcattgaatttagcacgcaaaaatccctttcaacccgatactgtttttcgatagaatgacacctgataatttgtttgaatattcaaacttccgataaaaatcactttacagagggcataatttatgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttggggtggtaaattctcaggcgtggcaaaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgacttacaacggcgagcccgtacatttaggtgcaaaagacatactcggccatgtttacgaatacttcctcggtcgctttgcccaagccgaaggcaaacgcggcgggcaatatttcacgccgaaatccatcgtttccctgattgtcgaaatgctcgagccatactccggccgcgtgtatgacccagctatgggcagtggcggctttttcgtgcaaaccgaacgctttattaccgcccatcaaggcaacatcaacaacgtgtccatctacgggcaagaattcaaccccaccacatggaagctcgccgccatgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgagtaaaattccattaaatgaatttataactttacagcgtggatttgatttaccaagtaacaaaagaatttcaggaagtgttcccgttgttgcttcaacagggattgctggttatcacaatgaaattaaagttaaagcacctggagttgtaattggaagaagcggaagtattggtggtggacaatatattgaaaaagattttttccctttaaatacaacattatatgtaaaagatttcaaaggacattatcccagatttatttattacttattaaaaagtattgatttcacaagttttaatgtaggaacaggtgttcctacattaaatcgaaaccatttatcaagcattttaatttcagatttgggaattgagaaagaaaaagaaattgccaacatcttaggaagtcttgaccaaaaaatccaactcaacacccaaatcaaccaaaccttggaacaaatcgcccaagccctgtttaaaagctggtttgtcgatttcgacccagtgcgtgccaaagttcaagccctttcagacggcctgagccttgaacaagcagaacttgccgccatccaggcaatcagcggaaaaacacccgaagaactgaccgcactttcacaaacacagcctgaacgctacgccgaactagccgaaaccgccaaagcgtttccgtgtgagatggtggaggttgatggggttgaagtgccgaaggggtgggaggttaaagccttagatgaaattgcaaattatcagaatggtttagcattgcaaaaattccgccctgaagatgacgaaccatttttacctgttgtaaaaattgcccaattgagacaaggttatgcagatggcgatgaaaaagcaaaagcaaatattaagcctgaatgcattattgataatggtgatgtcattttttcttggtctggtagtttattagtagatatttggtgtggaggtaaagctgctttaaaccaacatttattcaaagtctcatccaaagaatatcctaaatggttctattatttttataccaaacatcatttaaccgaatttcagcgtattgcttatgacaaagcagtgacaatggggcatattaaacgtgagcatttatctgctgcaaaatgcatagtgccaaatgacgaattattagcaaataaaacattagaaaatattttagaaaaaattatttttaacaggctggaaaatttcaatcttcaaaacacaagagatttattattacctagattgttaaatggtgaactcaatggatagaactaccgattatttagaacgacttttcattgaggaactaaactctgaaggcgaaattattatcagcggaaacagttttttccgacatgaaattttatatactcttgatcctgaagcatataaagacgtttttgaattttggaaaacagaaagaaaacaaagaaacttaaatgaagccaatagaatattggatattacttcagataatcgaaatcgatttattcgattaaaagaactcttcaaagagaaaaagattatcccctttattggagctgggatgtccatgtctacaggtttaccttcttggagcgaatttcttcgtagtgttcaacaagaaactagaactgatcgtttctattttgaagatctcttatcgcaaggtgaatttgaagaagctgctcagtatctagatgactgtagtccttcacacttacaagagcagttagataatatatttggtagaaaatatctatttaatgaaataaatggtgtaatttgccttttaccaaaattttttaataatactcctattattacaacaaattatgacaatatacttagtactgtttatcaaaaatgcgattacccattttctgatgaactaaatggattatacctagaagacctttataataaacttcttgataaacaaaatttcttattaaagatacatggtacttttgataaaccacaaaatcgaatactaacaaaaaatgactacgataaacactacaatgaccaaactagtaaattgaaaaattgtgtagaaagcttattttcaagttctctattatttatcggttgtagtttaactattgatcgcttaattaaggcgctagccgagattgttcaagaaaaaggcagtgaaaatctacctagacattatgcttttttattttcagatcctaaaaaggacgtgaacagaattaacaaaaaagaagaattagcaaaatccaatatttttccaatttggtatgatggcgatcatgatgaaagcattgaagccttgctggaattattaaatgatggagaacaataaaatgctcaacgaaaacgacatcgaacaactcacccttcaacgcctgcaatccctcggttgggaatatcgctatggtaaagatttgcctgttcatgagggcgaattttcccgtggcaatttgagcggtgtagtttttattgagcaactgcgtgaggcggtgcgtaaacttaatccgcagctgcctgaaagtgcggttgattctgtggtgaaatccgcgacaaaaagcgatattggcgacttggttgtgcgtaatcagacgttttataaattgttgcgtgatggtgtacgggtagaatatcaagatgatggtgagcagaaaatcgagatggcgcgtttggtggattttgagcatggggaaaacaaccgctttgtcgccgtcaatcagctggaaatccgcagccgtaaaggaggtaaacggattcccgatattatcggctttgtaaatgggctgcctttggtggtatttgagctcaaaaatccgctgcgtgaatcggcggatttattgcaggcgtttaatcagtttgaaacctataaagatgaaattgccgagctgtttgtttacaaccaagccctgattatttcagacggcattgccgcccgtttgggttcgctttcggcagattttcaacgctttacgccgtggaaagtggtcgatgaaaaaaataaaagcgtgcggttatattttgacgatgagttgcaaagcctgctcaatggcttaatgcagcctgaggatttattggactatatccgctatttcgtcttgtttgaacgggattccgttggcaaaaccattaaaaaaatcgcggcataccatcaatattacggcgtaaatgaagcagtagaatccacgatttttgccacaagcgagcaaggcgataaacgcatcggtgtgatgtggcacacgcagggttcgggtaagtcgatttcgatgctgttttatgcaggcaaactgcttgcacagcctgaattgaaaaatcctaccattgtagtggttaccgaccgcaacgatttagatggtcagcttttccaaactttttcttcaggcaaagatttaatcaaacaaacaccgcagcaagtagaagaccgtgatcaactgcgccaactgctcgcacaaaatgaagtcggcggcgtgttttttactacgattcagaaattcgccctaaatgaggaagaaagccgcttccctattttaaatgagcgcaacaatattattgtgatcagcgatgaggctcaccgcagccaatatggctttacgcaaaagctgcataacggcaagtttcagacaggttatgctcgccatttgcgtgatgctttacctaatgcctcgtttattggttttacaggtacgccaattagccttgaagataaggacacgcaagatgtgttcggtcgttatgtgtccatttatgacttgcaagatgcggtggaagatggcgcaaccgtgccgattgtgtatgaagcacgccaaatcaagctagcggagaatgctaatcacgatgaattatttgcagaaattgatgaactgctggaaggcgaagaaaacccgaaattacgcttgcgagaaaaattgctcggctcagaagctcgattgcatgatttagcgatcgattttgtgcaacattttgcaaaacgcaatgaagtggtggacagcaaagcgatgatggtggtttccagccgtcagatttgcgtggatttgtataatcagatcatcgctctgcaccctgaatggcattcggacaatattaacgaaggggcgattaaaattgtgatgacaggttctgcttccgatgcgtctgaaatgcagaaacacgtttacagtaaacaggaaaagcaaacgttagaacgtcgttttaaagacccgaacgatccgctgaaagtggtgattgtgcgtgatatgtggctgacaggctttgatgcaccgtgctgtaacactatgtatcttgataagccaatgaaagggcataacctaatgcaagccatcgcacgagtaaaccgtgtattccgcaataaaagccgagaaaatggcggcttgattgtggattatgtaggcattgctgacgagctcgaaaaagccactcggcaatatacaaactcacaaggcaagggcaaactggctgatagcgtgattgatgtattctttaaaatgaaagagcatttagaagttatccgcagcctgtttgcaacgccagttgaggggaaaacctttgatgttcaggctgccttagaaaaagataatccgaatgatcttttgatggcgattcgttttgccgccaaccatattttaagccttgatcaattatcgtttgatggcaaagcgcacgagcagcattggtttaataaaaaagaaaccgagccacgcaaaaaagcctttttgaaaacggcaggcttggtaaaaaaaggctatatgctgtgcggcacattggctgaagttgagccgtataaccaagaaatcgccttttatgatgccgtacgggcaattttaactaaacgtgaacaaaaaggcacaggcacaaatgaaagacagattttattgaaaaaattggtcaatcaaactgtgtattctgaaggcgtgattgatttattcgatctgctagaaaaaccacaaccacaaatcagtttgctttccgaggaatttttacaaactgtaaaaaatagcccaactaaaaatttatgggttagcgcgatggagcgttatttggcaagtgaaattaaagttaaatcaggcacaaacttaaccttgcaaaaagattttgaacggcgtttgaaggaagcattgaatcaataccacaatcacaatttgactgtggtagagattttggacgaactctttaaaatgagccaagatttccaagaacgtttagcattagggaaaaaactaggattaaccaaggaagaactagccttctatgaagctctatctcaaaatcaaagtgcaaaagatttgatgggtgatgaagtgctttctaaactggcgaaagaaatcacggaaacacttagaaaatcggtcacaatcgactggcagtacaaagaagcggtgcgggcaagaattagattactcgttcgacgtgccttacaaaaatataaatacccgcctgataaacaggaagaagcggtaacttatgtgattaaacaagctgaagaaattgctgaggatttaactggtttataattttgatgcggtttatttaataacaaaagggcgattaaaaacactatgatttttaaccgccctttattttgttaaaggttagattgaacgcttaacctcaaccacttcaaacacctcgatttggtcgccaacttttacatcgttgtagtttttcacgccgataccacattccataccgttacgaacttcagatacatcatctttgaaacggcgaagagattctaattccccttcaaagataacgacgttgtcacgtaatacacggattgggttgttacgtttcactacaccctcagttaccatacagcctgcgattgcaccaaatttcggatgacggaatacatcacgaacttcagctaaaccaataatttcttgtttaaattcaggctctaacataccgctcattgctgctttaatttcattcaacaattcatagatgattgagtagtaacgtaaatcaatgttttcagcttcaatgacacgacgagctgttgcatccgctcgaacattaaagccaacaatgatggcattagatgcggtagctaaagttgcatcagtttcagtaataccacctacacctgaaccaacaactttaacttttacttcattggtagaaagttcatttaacgcttgaacaatcgcctctacagagccttgtacatccgctttcacaataacgttcaattcagccacatcgccttcagacatattgctaaacatattttcaagtttagctttttgctgacgagctaatttcacttcacggaatttaccttgacgatataatgccacttcacgtgcttttttctcatcacgtacaacggttgcttcatcacccgctgcaggcacacctgaaagacctaataattcaactggaattgaaggacctgcttcatccacttctttcccgttttcatcacgcattgcgcgcgcacggccatattcaaaaccacaaagtacgatgtcacctttacgtagtgtacctgattgaaccaagatagttgccacagggccacgacctttatccaagtaagattcaatgactacaccacttgccatgccgtcttttacagcagtcaattcaagcacttcagattgaagtaagattgcatctaataaatcatcaaccccagtacctttcttcgccgatactggaacgaattgcacatcaccaccgaatttctcagaaatgacatcatgttgtaataattcttgctcaacacgatctggatttgcttctggtttatcaattttatttactgcaaccactaaaggtgcacccgctgcttttgcgtgttgaatcgcttcgatagtttgaggcatcacaccatcatcggccgcaacaacaagaacaacgatatctgttgcttttgcgccacgtgcacgcatagaagtaaacgctgcgtgtcctggagtatccaagaaggtgatcattttgccatcatccatttctacgtgatacgcaccgatatgttgagtaataccacccgcttcgcctgcagcaactttcgctttacgaatatagtcaagtaaagaagttttaccgtgatcaacgtgtcccataatagttacaactggcgcacgcgttactttttccgcgtttacatcgcgatcacctaataccgcttcttcaagctcattttcattgcgaagaattactttatgaccaagttcttccgctactaattgagcggtttcttgatcgataacttggttgatggtgaccatttcacccattttcatcatcactttaatgatttctgtcgctttcaccgacattttgttcgcaagttctgcaacggtaatggtttcgccaatcacaacatctgcttttactacttgaactggtttagtaaaggcttgttgaagtgcggtgcctttttttccatttttacctttaccaaacttagcatctttttgatttttacgattagattcgcgctcgtttttcgagtttttgctattttcatcgtcacgaccgcctttttttgcttttgctactttatttttacctcgaccacgattttcattacgacgatcttcttcatcttctgcttcaagtgcatatcttgaacttaaattgtaatcagaatagtcttctgaagaagattcattgtctgaatcatctgcttcagcataacgtttagcttcttctgctgcacgacgagcttgttcttctgctttttgacgagccacttcttcagctttacgacgaagttcagcttcttctgctttacgtttctctttttcaggatcaacaaatttagctttagaatctaccgcactttttgctggcttagcggtttctgctttcgctttttcagcttttgatttttcatcagcttctttcttagttgccgctttttcagcttctaaacgagctttttcttctgctgctttttgttcagcaatttttttcgcttccgcttcttgctgtgcttttaattttgcttcttcttgttgagcaatatcagtttttactgtgcgttttttacgtacttctacttgtacttctttgcttttaccgccagttgtggtgctgctcactgttgtttttgttctgcgttgaatgcttaatttttttggcgcatcagccttaacatcttcagtcattactgctctccttattcttcgccaaaccaacaaatattacgtgcagccataattaaatctgcggcctgttctgcggttaattcttcaatatcagttaaatcatcaacgccttgttctgcgagttcttcaagggtggtaatttgtttttctgctagtttgattgcaacgtgacgattcattccctctaaattcaataaacgatcttcaacattcgcttttttcagtgcttcttcttcagctactgctgcggctgtaatcgcatttttagcacgagtttgaagctcttcaacaagatcttcatcttccaaaccatcaattgctgtcaattcattcattggcacataagcaatttcttctaaacttgtgaatccttcttctacaaggatttgtgcaaattcttcatcaagttctaatgcgttaataaataaatttaacactttattatcttctgcttgatgcttagcatttaactcatcagtcgtcattacgtttagtgtccaacccgttaattgtgttgctaaacgcacgttttgaccattacgaccaatggcttgagcaagattatcagcttcaacagcaatatccatagaatgattatcttcatcaacgataatagaagaaacatccgcaggtgccatcgcattaatcacaaattgtgctggattatcatcccaaagcacgatatctacacgctcaccaccaagttcattcgtaattgcctgaacacgcgcaccacgcattcctacgcaagcaccaactggatcaattcgcttatcatttgatttcactgcaattttagcgcgagagccagcatcacgagctgcaccacgaatttcaatcatttcttcgccaatttcaggcacttcaatacggaataattcgatcaacatttctggtttagaacgtgtcacaaataattgtgcagttttgccttcaggatttactttataaagcaccccacgaacacgatctcccggacggaagttttcacgtggtaacatatcttcacgtgcaatcatcgcttccgctttattgccaagatctaaaataatactgtctcgacttactttttttacagtgcctgttacaatttttccttcttcttcacgaaattgttcaaccacttttgcacgttcggcttcacgaattttagtgctaataacttgacgtgccgtttgcattgcaatacggtcaaatgcaatagattcaatttgatcttctacatactctccaagttgcaaatttggatcatcaaattgcgccgcttccaaagtaatttccttcgttggtacttttacttcatctacgactaaccaacggcgaaaagtatcaaattctcctgttttgggattaattgaaacgcgaatatccgtttcatattcaaacttcttcttagtagaaatcgcaatcgcactctctaatgcttcaaaaattttctcacgtggtaataatttttcattggatacagcttccgccgccagtaaaatttctttactcatttctctttttctccttttaaaattttgcaacaacattcgctttttgaatgtttccgaagactaaaatttgttcttgatcatcaacgattaaagtaatcatatccttttcaatacgctctaacttaccttgccatttacggcgttccatcactggaattcgcaaatgcacagcgatatcttgcccaatatagcgttcaaattgcggcaaggtaaatagcggacgatctaaaccgggtgacgacacttctagattatatttatccgcaattggatcttccacgtctaaaattgcgctcacttgacgacttacatcagcacaatcatcaactgtcacaccaccttctttatctataaataaacgaactgtcataaaacgacccacgcgctgacactcaattccccacaattcacagcctaaatcctttaccgcatcttgtagcatttcttgtaaattttgttctaatgtagccaatttctactcctatatagggtgtaattcaccgcactatatcataaccttatgaaaccttatcctaaacaatacttatccctctattttagtaatagtaagaagatagtttattaaatctcaggcataaaaaaagggttaggttcataagaacctaagcccagttactaaatttcttatagaaaaaaaccccaaaactggggttcttttactgaacttattattggttgcgggggctggatttgaaccaacgaccttcgggttatgagcccgacgagctaccaagctgctccaccccgcgtccgaaatatgtgctacattatagtgataaaaatttaatatgcaagaaattttataaaatcattgatgataaatactagaataagataacattttccaaaaagtttaggagctaattatagcatatatgctgtgttatatttttaggaattcgtaaatatctttaattttgccataatttacaaatctatagctcctatcatcaaaaataaagcgtgaaataatgccaattaattaacgccattatcaagcctcccgtccataaaaaatcaatgatcgtctccaatcaatttagagatgaattgttaataaggtaataagccaataataaatagacaatatttaaggttattctagctttcatacaaaaattcaatcaatctcgactttccctagctttctttttttgctagactaacacgcaattttggggctgattctggattcgacgggattagcgaagcccaaggtgcacgtcgaggtgcggtaggcctcgtaaataaaccgcaaaaaaatagtcgcaaacgacgaacaatacgctttagcagcttaataacctgcatttagccttcgcgctccagcttccgctcgtaagacggggataacgcggagtcaaaccaaaacgagatcgtgtggaagccaccgtttgaggatcgaagcactaaattgaatcaaactagcttaagtttagcgtgtctgtccgcatgcttaagtgaaattaaagacgagactaaacgtgtagtgctgaaggtagagtaatttcggacgggggttcaactccccccagctccaccaaattttaaataacatcgccataacaacaccaataaaaacaataccttagaggaaattcactaacggcgatataactaaataataacttaaaatgatccgtgaatgagccgcgggctgttctattccctaagtattaaatttcttggtaagaataatgcgtgaggcaaaatcataggagaatctatgaaaaccctatatttttgttcccttgatgggaatccaagaaaagtatttcaatcagaagaattagctaaacaatggaaagaacaggggtaactttatttttcaagcgaagttgtatatgacgaatcaaacaacattgtgaaaattgataatcaggattttatagactttgttgaaaattgttctgatgaacagggaatagaagagtttgagcaagcaaaagcaattgtggaaaaagacttcgcttttgtaactgtaacggacgattagatgcgttagaattaattcaagtaaacattaactttactgttaaacaagcaaaagaaggcggggctaaaacctcgccttttgcttttattgaaatgcgaaaatctgaccgcactttttagaatgttcgcggaatgaaagttgatgattgatactgtgtacgtttttgcgcccagtctttagcatccgctgacgctttggaaaactgcaaacgagcggcatcttcacttttctgtcttgcaatatctgccgcctgttgtggagtgagattatttacatcaatcatattgcgcacaggaggagcgacagaagatttaacatcctcagctaccgtttcgcgctccactggtttcggattgtacaaatccatattaccaccaccagtcatataaagcgcttgtcccatctggccagcccccttaaatgcagcgattgtatcagggcgtttaagataattctcgcgttcagcagaaacagcattgattcttgctgcaatcgcattttgttgctctttatcttctgttgcggacaatttttcttgcaaggaatgtaattggctatcataaataccaagcgtttgagttgcgccaagaagatttttttgcgcttctgattcaccaccatgagaataacgtgctgaaattcgagcttttgcagccgccgctgaaatttcattacgggttctatgatcttcaagctcaaactcgtgcttgtattttttatcaagcaattcactatcaaaagcacgttgtttgtcggcttctgccgttttccaatctaacaacttttgagtttcttcatctttccacccttgctcaacatttttgacaataccagttcccaatccttgtgtcatcgcacctaaaattccaccccatcccataaattatgccccttgttgcattggttttgattgaccgttttgcacttgcgcacgacgttggctttccatttcagatactttgttgatcatatcaacgtattgctgttcttcttcctgaggtaacgcaccgtgcgttgcttcgccaaattgctcaagcgcattcattaaaatatcaatcaatacatcatcaatttgctcttctggcacaccaacttgctgtaataattgcatagctaaatctttagcgacttgcatcatcacttgcggcggaatagtttttccattttgttgcgcggcctgaagatttgaaatcattgcttttgcgactaaatcggcaataccttcttcgggacctttttcttgaatacgttgttgcgcaacatttgcgatagcattaatggaattttgcatcaacatttgatacatctgcgccatacttccctgttgttgtgaaccctgtggattttcgaccgcactttgttctgttgtctgcggttgtgattgttgtgtcattgaatctaaaatgcccatgaatttctcctatgatacgatgatatttgcccaataatttcttaggttaggaacgtcactcgttttgacctgtttatcaggatctatattttgcatacgattatacatagtgttcagtatgccttttggttgtgtattgtcactgcgtaaatcacgcccagccataaattccttataggcttgacgttctttttcagctaattcattttgttgtgcgatgtggttatttaatgcgttagagttaagcgtctctgttaaatcacgtaatgattttgtcatcgtgtcttttttgttgatcgctttacctaataaaccaatcccagaccctagcattgcaccaggaggccctaaagcagataaaccgacttgtgcagctgtaatacctctatcaatccatttatcgttcgtttcatatttttcccgagcattcttataggacttattgatgaaatctactcttgtatcgtaatacgctttcccctctggagtgaggctatcataatacgcttgctcttggttgcttttgaattgtcgagataaatccccaacgtgggaaagcccaaaatttgccgcactttcagcaattttgccaactggcgttgttgctgccccgcccaccccactaaaaacgcctcctacagcacgaccaattaagttcaattcttcgccccgtttaatacggtcgtaactattgatgtccgcccgttctcgaacggatgaatattggggatcgcttgaccatacatcgccgttatttaatgtcattgaaccacgtatgtttctatcaaatatagaaggagtgcgttcagaataaggcgcattggagtaactttttccaaacaaaccgccagtgagtgttttctgatctttttcaggaacggcggcgctcatttgcccattagaaagtgaatgatatttttcactaattgttcggctaattgcgctatgaccaccgctccaactagagttatttcttcgctcattaaatgcatcagtatagactttgtcttttccgtatctagatttgtggtcattccatctatctgacgtactacgataactatcactactgttatcttctcgccaaccacctccaccggaaaaggatgaatcagaatcactagctcgctcatagccagctttttccattgactcaccaaaactatcatgcaactctgccattgttagcccctttagtttcagaacgtttcttcatttcagtcaaaataccgccatttgccaatccaggagaatcatccactgtcaaacttttatacgaccaatccgcatctggtacggctgaatattttgatttcatctgatcttgcagatttaataactcacgttgctgattgatcaaatctttaccagcttgtttttgcgcaaagtaaccaccagcaccagcaataacattaccgataatattacttgctgctttatggttgtccatccaatccattgcacttccagctgtttcccccagccatttaccagcgccactaattgcatcccatgcaccatcccaaaacgccataacctttctcctcttaactaatttgaattgacggaacacctaagctaggaaatgacgaccagttttgttgcgtggtcggaattccctgcataaacttactcataaattgaatctctgaatctcgacttgcttttagctgctcaatagcctttgttttatcctcagctttcatattcgagttattcaagatcgtggctatttgcgcatcaaagttattggtgatttgcatggtgaaatcaatggatttaccaatagtgttcgccgccacttgtgcatttaagttcttcatctcattttgatgattcaaattcgccatatctttttgttgttgccgttcaagtgcggcttgagacgcagtgaattgattttgtgcctgatttaatcgactttgattgctataagctaaatcagattgtaattgcgccattccacgctgatgaccgcgttctaattctgcctgcgatgcggtgaattgattttgttgctgattgagcttactttggttttggaaatttaaatcagcttgtaagcgagtttgtttttccgcaaacgcattttgcgtatcttggcttgcaattggtattgccgcatcaagcattgcacgttgagcagattccacaccaatggttgaattttgcaagccgcgattagctgccatacgttctcctttagcagccgcgctattcattaaaagtgaattgctatttaataaattagagacattacctgccattgtctgtgatgtatcttttgtcggagattgagtggaaattgttggggcttgcggtgttttagttttattcaccgcatccgtcatagaacctagaattgacatatattctcctaaaaaaaaaagaccgcttatttcgcagcctcttgttgaaaatttatttaattattacttacggtggtaaaagcaacagcaagctgattcggactaaaccgccagccttcattgctatttttaatgcaattaaaacaccattcactgcaaaaatattttgatcgtttttgtttgatgccgagcacaatcccgacagcaccccaccagtcgtatttacagcccaaagtgcggtcaaaataggctttgatttgtgcttcggttacaccgtcgagcggaattaaatcccatttttctctatcataaacatcaatttgcttgcaacgtacgccaccgtctcgaattgaagacgaataacactcgtacatcacttctgtttcatagtgatgcccactgacaaatacttctttcattactgcaatttcacaatgcgaatacacgccttttgtcaatttacgagtgagccagtcactcaaacgtgccaaaagtgcgttcgggtttttacccgtttttttacctttgtataatgcgagatagattttagtgcctatcattgttgtgcctccgctagttgtcgcatttttgaaacaatatcgtcatgaatgtttttcagttcttcatcactcaacgcctcatgctttaactcatacttacgcattctttgcactgctaattgttgttgcaatgcacgtaatctttctgcttgctgaagaatcaaaagtgacgcagactgattatcaagacctgcaaccgttgcaaaactgctgatataaacgcttacttctccagcaaaatttgcttctttaaaggcaatagcggcagcttctcgctccttatactcttcggcaaaccttatccatctagaactgatgttcgccgctgtatcatcaatgctatcaactagatttttaatgagttcacgcttaatttcagttttctttttttcatcgacaatccagctgtttccgttccatttgtgtaattctgttggttgtctatcaactagaatgtattgacttttaaaataaataagttgtttagtctcaagctctgattcgttttctacttccatttccacaaaatcatttaagttttgcggaatagggaaaatttgataactattcaaattttcttttaaaaaatagactttcattaatcactccttcatcgaatatcaatacgttttacaaaacgaccagcaagttcttcaatgtgtattgttgtaccgtttctatcaacagtcacagcgaattcctcgacttctacatgatacacactagttccaccagaactgtgtggaattacttgacgaatactactaaaataaactccaccgccccttttaccttcaatctctgcccctacttcaaaactgacaatttcaatattgttattatcatcaagcctgtggcctgatgatgactgaagatacaaaataagtgttttaccaaaacacttttctgaaatattaatactcccagaacttacattaccttgccacactgtttttaatgtgccaatttgagataaattcttttgtgcctgcaaaaattgctgatttatatcaacttttgcattgtttatttcttgtaaagtagattgtttattttcttttatttcttggtcaaccctcgcagataacgcttgcatattttgcacaagtgtacccgcatctaaaattcctgcgttctcaacaacgccgaatgctttaacccaaaattgcacgtcatcaaatgtgttttttgcttttatacaaagtttgagaataagcgatttagggcgagtttcatctccacctgttgccatcggggtatctaaaagcggatgcataaatccattatcactgagattatcatcggttgtagttgcagtgcataatcgtgaatctataacagttttcgttttgtcataaaaaatactactatcagatgaatcagcccagtgtgttctcactctgtgaacgtgctttttaatctcgtcactttgtgtctgaccgatatttaacccattccctgtatttctaataaatcggtcttccgcaagtggcacatttgaaatagaaccatatttaccgaccaagtgacgatataactcagggtaacgttgctcggtaacttgtgtggcaatctcgtcaaaggcaatccagcctgcagggatattatccacggcaaaataagccgtcatccccacatcgctacgggttaaatcagggagtttgttgctgttgcccaaagtgcggtataaatcgggaaaggtttgttggctgaatgttgaaccatcagcacgtaaaaaaccaacgggattggttaccgcacgagggaatgatacaactgcaccaataggcacgccgtcgccgcctgcatctttccattctgaccaacttgaaccattaaaaaagcgtgttttgattttgttatcattcgctttacgtgcaatttgacgcaccgcatttgttgccccaccgctaactacttcaatatgccattccccattttcgggtagattttgaccgcttgctaagtaataattgccatcggttttatagccattggcatcgccctgcccttgttctactttaaaattcccaataccatagcctgcaagtgtattaggcttgccttcaatatccgtattaaattggggttttgccccagcgtggtagattttttggcgtttgtaggttaaatcgccgttagcgtgcatacgaagcgtgccaatctctcggttgcttgatttatattcgaaccagcaatcgccattgtttgccccgatatttaaatagtctccgcgtgaagcataatgctggctgtctgaaatacggatatttctttttgccacaatacgattttcaaaggatttctcgccattaatgctttcgttaccatttaaaccaacctttccatctgcggtagttttggcttctactgctttgtcataggcggttttggctgctttacttgtcgctacgttatcttcgctttcgctatttactgcagaggattttttgctgttttggatgtaattttgcgagacatttaactgtaattgtgttgtttgttgagcgagttttttccctgcttttgcggtgagtgcaagagattcactttcaagccctgtgtcgttggtgagttggactataccttgttgtgtggtgcttgccttggctatttggtggctgtgtccgctttcattaaatccattttgcgttgtggcagtaatggtttttggtgtcatttgttgtcgggtgacaaaaatcacactgttatcaatagataatgtcaccgcactagaagattctacttttaagatcatccgcaatacttggactttaccacttccgctactttctgtcggtttaaaactttcaggacagtttgcgtaggcaatgagtttgttttgtgcgtcaaatacgcccatttctcttatgtaaaaaccgccgatattttcagggatggttaattcaacgatgacttgtttattattgcgagggtcgagagagacggcactgacaggtgcaatgtgcgtttgatgtacgagagctgttgcgttcgccgttggtgtgaccgctttcccattgccatcacccactgcaaattgggtgagctgtaacggttgcccttggcttaatgcgtgagcgatagcacgtgttccgtagtcggttaagattgcaaaatattgtgatgccataaatattcctattgtggatataccgtgatgatttcgccccattgctgaccaacaaaggcacaaagtgaccctgttggggagagggcgatagcgagctgattgagatgtcttgagacgggtttaacatcattaatcagtcgcactagttcgttataggtttgttcattcaagccactttcagacacttctacggttaggctaaatgttcctggtgtgccttgcggatttgtttgaaaccattctttcagttcaataagatagcctattggctcaaccacacgctttactgcgccaatcgtgcctttgtgtttgtgtacaaaataagactgtttaatcgcaatgcgtttaacttcttctgtccagttttcatcccatttatccactgaaaacgcccaagctaaataaggcagtaattcggtgggacaacgttcagggttgattaaatctgcaataacaatgggattttctaccgcactttttagaatttctgccgcacgtttttctaatggagttgcgcctatcggcagtaaatgattagtaatcatcacttgtcactatctccaaattaattgccgtgcagtaggctgattttgagcttggtagcacaaggtcggcggtaggtgagataagctctactcgttgtacaccttccaagtgtaatgcggcataaatacccgataggctaatatctcgccctaaacggtgtttttcttcggtgtaagtggtcaatttttttagagctgcagctttgattggctcgtattcagggccacgataaagatgtaatttggcgcggatttcgtaggattggatcaccgcactttggacaataacgcggtcgccaatagggcgaatgtcatcatcattaagtttggctctaactacatttaaaaggttttcgtttgtttcaccttgtccattacggcttaaaatcgtgacggtgacattggctggctgtggtgataccacagacacatctgcaacatcagggtgtgcagagagtgcgtggaagatataagcagagcgaggacccgccacagaaagcccctcaaaggctaattgcgtgcgcaatcttaatgaggtgtcatcttctaaaatttcggggattttaggcgtaacattattattcgcctcttgaatgacttgtcttttcacattgtaattggcggcaatcacatctaaatctgaaccgctggcataggctaacattgtggcttttgccgcattgttgatgcggtttctttccatcaactgtaagtaaaccacttcttgtaataatttcgtgatgggctcactttctaaacttaatcgtgcttgccaaaatgccctttcatcttgtgggaaaagtgcgataaattccgcttttctgtctgcgagcaaactttcaaaatctaaatcttctagcacttttggtgcatctagttttgataaatcgactaattcgctcattgtttatgtcctaaaaatagtttttcgttgtgcatttcttggttatctttacgactgcgtgcgacataacttgccacaatgccaccttcaaccaattcaggtttaaattgtgtgatctgtactcgaggttcccaacgattaatcgcagtgacggcacaagccgccagttgtaataacaatgtgtggctaattgggcggtctattagcattgggattaaactgccatattcacgccgctgaattcgtgaaccaactggcgttagcaaaatatcggcgatggattgtttaatgtggtcgctttcgttttttaatgtttcgccagtgtatcgattcatactatgcctttgcgttagaggttcgttggccatcgccttgttcaaggtggacgtggttttgtaaactaattgagccacctttaatatcaccgcttgcggtcacgctgccttgcgtgctgatattgccttttgtggtgcttgtgcctgtggttgataaagagccgtcaatattcacattacctttgatattgatagcggggcagtcaatatcaatttgattagcggcagtaatactggcggttttgatacctgtcacaaccaatgcaccacttgattggttgtaagtgattttggcaccgtcagcaaattcaatgacgtgttcgtcgggcgattggcttgggctattttgtgtgtaaagcccaactaatatgcaggcagtagtaaattcaccgctaacggataacatcacacattgttcgcccaccgtcggcggcgaccaagttttggttgtacccgctcgaaatgtaacgaagggtaaaaaatccgtcagaatgtcaccgctctttacgcgagctcgtgcagtggcgtgattcacttcagcgattaccccaaagcggataatgttgtctagttttcgttgtaattcagcagacataggcattcacagttaaagaaaatgccttattgttggcaatattgtgcggtgtggcgagtgtgggagtgtgtggaatagtaggtaacaaaaaagggctttcgccctttgattatgctctgtcaatgattgggtttggagtgtcccattcgcgtgggaacggttcgtgttgtggagaaaaagcgataatcacgatatgttcatctgatattttttgataatgaattacaggtcctgatgtttctccattcaaatttatttttagcccactcataggacaatatctagatcctttattgtaagggccgcagtgataatgccatatttcgttttgttgataaacctctgtatttggaatgtcattgagattatcatcaagccaagatggtttatttttacctcttaatagtttcccttgtttaatggattgcataaaatcaaagatgagctgcaattcttcatctgacatggcttgaatgtctttaaaaaagggcgtgtttaaacgcccttcttgaaattgtttcgataactcaatcttcatttgttatcctacatcatcactgcttttttaaaatcatcaaaagaatgtgatgatttgtaggtgtaccctgcatcttcagatttgcgataaaggcgtgataacactacttcatctgattgttgcttgtatttttctgatttcatcatattgcaaagcgtgtgcattttattgctgaatgattgtagcgttgttgataattctggagttttattattgaccataatattgttagctagatcatcatatttattaattttgctttctagtctcagaacgtcacttaaatcaatatagcttaatgattctgccgtaattgacgcaataacaaaatcagtgatagcagaaacagctttcaccatatcaataatcttttctatgtcttgttgattgatcgatttattttcatctgtttgaacactgaaaatattgactgtgtgtgtagtgtgacgaacaggatgatttatcgccaatggcgcaataaataacgcagacattgccacggtttttaattgcttaaaaattggcgcaaaactttcaaaaataggatttaatgatagatttgtcataagtcaccaaagaataaaagtttgcgaagtttacaactttttgaagaaatataaaactattttctacaatgtgcaacaaaaaagggctttcgcccttttattttttattacctaattgaataaaatcatcaatacgtttacgaatatctttcattcgttgttgaatgaatttttcttcttttgtcccgaataaggtatcatgatcaaccataaaacgaaccgacactgtggtttgttctgggttatcttcataattaaatgttagcaccacaagaggatcattttcttcataacttaatctagcgtgatataaaccaatataataaggcgatgcaccataggctaaactgctgtcttttgcacgtccgaatagacggtctttattttcaacataaacttcaacaaattcttgttgctgccataatgcgattaattcagcgagattagtcgaatgtttatcaatatcttgttctgtaaatcccaatgcaagactgatttgcgtaaaaagatgatggatttcgacaaatttaatatgtttgcgttctagcatttaattgtgtggctctaagttgtgcttttaaaatggtttgaacatttgccttgatttctttggcattgtcacccttcacacgttcgccttttatttgcgatgtgcggtcaataatttcacgaataaaaggtgcattttcgttcattgataccctcctatttttcgccgatcctagcacttctgtttacaataaacaacaaaaaagggctttcgcccttttattatgctctgtcccacattgaacttcttgctctggcttggcgttggttttcaatgcgttgtatttgttttgccacttgttgtgcaatggctcgttcgtccatgccttgtgcggcattgatggtgatatttacgctcattggttggctggtttgcgtcatcattggacgagcaaaaattggtgcacgagtatcaacttgcacaggggcggcagttgcaacgctgatccccaatccgcccgcaataagtgctcgtttgccgtaattaagggcgttgagcgtatttacaccaaggcgtgatgtggcttctttggtcatcacgtattcgccaccgtggacaatgcccatgggttcatatttgccaccgtttccagtgtagccgcctgaccaattttgactcggtaattttttgccatttgaaccaaagccagtgaaatccttaaatgattcccaagcacttcctgccgtttcttttgttgattgccaagcgttgctcgaagtgttttttgttctttcccatgcactagatacactatttttaattccctcccaacttggcatattttcagaaatccacttgataccatccattaatcttgttaatggggtcagaataaactcaatcgctttcgccattccatttccgaatctttcccctgcactgactgcagcatctaaatcttctttggtactttgtactggagacaataaatcagtaaaccatttcaccgctttttcaatccaaccgacgacaacaccaaatgcggtgcctagcggttggaatttttcaaggacgggggcgagacctgattttaaaccctcccaaaaaccgccaaaaaaggctttaataggttgccagaatttataaattaatgcagcaacggacaataaagctatccctagtggactgatagccagtgcaattaattttagcggagaaagtaatcctcttaatattagccgccctgcagatgataaatgtcctgaaaatttaggaataattacgtttaatttggataagcctaaaaatagccgtgcggctgggtaaagtataaaacttaaagcaaggcttaatgcacctaatagacttaaacttcccccgattgcaactgctgtttttgctatagtagaggttaatttaggatgttcatcaatccatgtctcgattttatcaagcaaattgccaaccccgtccattaagctagtcatcgaatcttttaaactggctcctacagaactatttacgttgaataaacgatttttaaataattgccattttgctgataaagtagtcattctggtttgaaattccctagccatactatttttagcttcttcgctatttgccagttcaatttgtctgcgccattcttcggtattggcaacaagccctgctaattgggtattataatttccgcctgcaatatcgctaattacgccagcctgtaaatgtttaggcaatttttttattttttcaacaatcatcattaatgtgccttgggcatcttttaccattgctttttgaatcgcttttggatctaaacctaacgcttttagtccgttattaacgggtttcattctagtggctttacttagacggttgaacgtactttcgattgctttggctgatgtactggcttcgtttcctgccgttaataaagttgaaccaagtgcagcaagattcttttcactaattttgactaaattaccaattcctgatgtgttatttaggaaattaataatatctgtcccctttgaaatggcattatcatctaaatagttaatagtatcggctagctctttggcatctttggtggttaatttaaagtttttctgtactttaccaaataactctactaattcatcggggttttctgcatcaaatgctgttgccatttgggtatttaagcgaataaaatcttctaattcattttcctgaatatccattctcgctgcagcagtaaccatgtcaccaatttgatttgtggtaagaggtaattcagttgaaagctatttaatcttgtttttccattcatcgtatttaggggtaaattgcccaaatttgtcttttagccctggaacttggcgagcaacccccgccataacatcttcaaacgacataaaatctcgaatggaattgacaattggtgcagtcattgttgtacctgcagctgttgcctgtgcaccaatgatttgtgctttaccactgatatctttaagtttctcaacttgcccacggtattgattataagcggcttgttttgcgttgagttttttcaatgcggcttcttgatttttaatttgatccgtcgcacttttggtgtttttctgtagttccctttgcttttgcgcgagtttttctgcagaaatgcctgattttgctaattcttggcgtgcttgctgtaatttatttgctgcatcaatttgttcttgcttgagtttttttaccgcactttttgctttctctacttccttttgaaatcctgcagtaggatgttgagcgttcttcatatattgagcataagatgcggctttttgttttgcttgctctaattcttgattcagcgaatctaattttgatttcaatgggttgatagcagaagcatattgtttcattgcagcttgatgctgcttattttgctgatttagttgtcgatgaatcgatttgctttcttttagttttgccgatagctcatgaacgcttttagatgcactgcgaactggagcagatattttatcaatggcatttaataagactgtaagctctaaatttttcatttttacccactttttcttgacattttaggaataaggaacaaataatgaacaaacttaacagggagagaacgatggaaatttttgttttgctcattggtttgccaattattgttggtttacttattgcatttggtactgcagtattagccgcatttagttatatttttgttggcgcattatctttagcgattaatttctggtatatcacgttagcagtaatgcttgttttgcttgcacctcttatttatttaaatagttggttattttggattttggctgcactcgttattttctttactgttgcttggttttttggtggcgataccgaacaaatcaaagcagaaattgaacgtaaacgtattgctaaagagcataaattgtaaattaacccaattaaaattctttacccgctatagctctaagcacaaatctttcaatcatttcaatatcttcttccgcaaagcccagtaattcacgctgggcatattgcactttgaaatctttattgttagatggtcgtgccgttaaaccgtattgatgcactgcgaactggagcagacattttatcaagggcatttaataagacggtaagttgtaaattattcattttttcgccttatttttattgacaaataaacgtatgattgctaataatgaagaaagagaataaggagcggatatgaaaaacaaaagaacatctcgcacgttgatcatgctaaacattgctatgtggagccttgttattatttccacctgtttacattatcaatttaatcctttttcatttatctggtttgatgttatcgcaccagttggtcatttttttgcagtcgttttttctgctttatctagttttactgtttcaatgtatgaactttttaaaccagaaacattttgggggtgggtatggtttgtaatgtttgtcgtgccaatcatttgtttgcctctttatgtggttttattggtattgtttgctggtaaactttcacatcatgatacggtggttccaccttcttatttaaagtaattagcttttgctaatttgttctatcaccaattcattcagcattgataaatcctgttctgaaatgcccaatagttcccgttgggcgtatctcactttaaaatccttttcttttgatggtcgtgccgttaaaccatattgatgcactgcagcaatggcagcacttgagccattaaaccccactgaaacttcgttaccatttgaccgcacttttaaatgacgggcggtgcggagtttggcgaacatggctttgcgtttgattcgccctttctttttgccaaattctttacgtggttttctcggttcaaaggctgaaccatcgggattttgttggcgtgcaattcggttcgattggctttttcgtaaggcttgcccgatttttcgcccaagctgtctgcgagcctgtggagaaagattggcaataagtgcggtcaattttgcctgacttcttcgactgttgccattagactgtatccccctcaaaaaatggcgaatcccttgttttcaaatagacttttactcggtttggtccatcccatacgggttcttttgcgtaatggatctgcacgttattcccgtcttttttcgacacgacacgctcagtgagttggatttcaaaactaatatctgcggtgttgttattgttgtaatctatctggaatttaaatgcgttctctcgaatttgtggattttctaatatttcaggttgatttgtgcggaggtaagccatcattggcacaatcaaggtggcaatatcgcctgcataatcagtcactacaacattgagtgtgtaacgatattcaaaactaaatgatgcggctcccgttgcgacgatttgcccaccgtccacataaagttgtagatggtcgggattttttacaaaatcgggatggctttgttcaaggattttgcgcagttggttgggctttttcattttgcgtatctctgcaaattaatggtcggttgtctttatctacggcaacaatcaaatgtccagtgtccgtcatcaaatagcctacttgatgaatgcatacttctgttattcttccgtcaggataatttgaatatttacaaatggaccatctctaaatggcacggtgtaggtatttgctaaacaaggcaatgcggcagcgatagcaaggaaaagtgtggttcttctcattttctgaaattccgttgttgtatttcaaatctttgttggcaagtcacgcaacgtgttacgccttgaatcatttgtctgcgcttttctgggatgggggcatcacaatcttcacaataaaggcgacttactgctttaaaagtgcggtgttttttgagggcgatttcgcgttgcatttcttcaagctgttgtgctcggtcgaattgatctgtcatggctgttcctttttattaaattcatctatgcatttttttaaacttgagttctcgataatgcacaaatcaaggtggtgttgtgtctgtaaataggcttcggctaattcgccattggtgcgaatttgtggcgaatacgcactgcactctgtggtttgtggacaaagaatcggtgatttaatgacttcctgctgagttgagcacgcgtttaacatcatcaggcaaagggcggttagcccaatcttggtttgatttaagtacattttttaaatcctgtgtttgttgattttggtttgctttgaggttgtttacggcttggattagctgtgcttgctgttcggcaaaattttgaacgctatgatttaactcaatgtaagcgttttgccatttcagttttagctgttcttctttgagcatttcttttcgccaataattagccttaaatcccagaaaaacaatgaggagtacaagcagtattggcccgataaggaaaatgcctcgttctttggcggttaagaaattaaacataggtttttctccttttgacggcgttcaattaatccttttagcggttttcctgctgcataaatccaacgttcgaattgaccgcacatggctttgctgtagccttggcgtgccattttaaaaagtgagctattttttaatttgccgcatcctacgttaaaggtgatggagacgagggcatcaaatgcaccttgtggcatggttttcccgttggcatattgattaacgcatttttctgattgtttaatgccttttacgtataattcggcaatttcttgcaaggtgtaaattttattgcggtcaattttttcaacggcatcggttatgcctatgccgactgttaaaacatcggcagggcattgatagggctttttcatacaaccttctgcattgccaatcagtaacaagcctttttcggatgttcgaatttcatttccatgagaggcaatcacaagtccaacaacggcggatatggcgcagatgtatttggcggaacgtttaatcatgatgatggatccgttgtctgagttctttttcttttaattcaaaatcttttttcttgtaataccaatttacaagaaaggtggcgacaccaatcacaatacctgtaatcgatgcgacatcagcccaatttacatttgagaacatatcggcaatgcgtccaattaagaaggcgaatattcctgatgtgtaagatgcttttgatggtgcgtcgtgcatatcagctccaaagttgaattgtgtcatttgctacactgattttttctgtatcggcatctggcaatatgacaggggtaccaatgggaataatgggcttatccattaaatgcggattgagttcgcatgttatttcgagcaagccttcacttcgtccaaaatgtcgataaagaatggcatctaaattgtcattttgttgtgcgtaaacttgcattagattaactccgcatcgacgcgttttctgcccaatatgtcgctaatcgcaaagcgagcatcacgacgtaattcatcaatgctgtctttgagttgcgccattttcttttcgccatcgttagtgctgtcatagcttgcatagcgttcataaaggtttgccagtgccaagcaacttaccgcacgtttatagcgataaatcagtacgctttcgccattgattgatggggcgatgatttgttctaaactgtcacgtttgctttgcgttttaaacgtggagagttcggcattgacacttgccatgccctcaattaaggcatcttgtaaacgttgtgtagtaatggtgccgtctgcacggtattgattacgaaattgggaaagtgacatatcggggaagaaaccatcattactgataatgtcatctgacgtatcgtaatcatttaactgttgctgcacttcgcccatttcataatcaggggccagtttgactgatattgcgccgtcgctcattgatttacccttataaaaaaagtcgggtgaggattaaattaagcacggccaataaatccgtcagaatttgaccgcacttttaatccgcccgacggctgcgtggtttgctcggtttatattctttcttgtttgtgcaagaaagaaccaaagaacacaccccgattaaatcgcttttctgccctttgttgtcattttcttaacggaaaatttttaactcgctacgctcaaacaagaaaaattttcctaaaaatgccaagtcggtcaggcgatttagacggggcattaaaacaacatcaacattcagtcgctgataattgtttttttagtttcttgatgtcgcctttcacgccaattttttgatctaaacccaaagcacgttctaaatatgccagtgcttgctcagggtgtttttcaaccaataacaaacccaattcacgcaataatcgcgctcggctttcatctggcatatcgcaatcggcggtgatgcgttggacttgctctaagtaagccacttcgaacggtttattggcagcttgtgcggctttggcttggtcggcaaattcttctgctaacaaggtgccaagtgttcgagtgaatggctcgggcaagcgtaaatcatgaaatacggcataatcggcaatttgtaaggcgagatgatattcgccacagtcaatcgcccacacgcaccatgtcatcaagacattatcttgtttaccacttccgaccgataacgccccttcaatccatggtagatagtcaggcaaaatttgctttttaaatgcgcctttgcgttccgtcgattggatgtttttcaaatcctttcgatggcgagcaagaatacggcacattttttcatattccgtaaagtcgcttagatcttcggtttctgccgcattagcgatagcggcagaaacttccagaaagtggcgtttagttgggcgcataattgattccgttatgcagccactggcgaaataggcgtaggtgcttcaagaatggtgatatttttcgccatggcgactgcctcgtagttttccacaacataggcttcgtttgacgataaataatcttccacacgattgcgttctggtacatcttttaagtgacgacgtactttgccttcctgcacgtagattgacaagttatcaagcgatgtgactaacactgtgcctttcgggaagaatgggacagatacggcttgtaacccacccacacgtttttggctaatgacggtatcgcctgccaaaatttcgcttggtttttcttggttgattaatgggaagtatttatcggctaataagtcgctacccataattgcaaccagttttgtatcgtcacggtattgcgctggaatgaaatcttcttttaatgcaaagacaagggcatcaagatttttataggttttacctgcgccgatttcgattttgccactgctttcttcaatttcttttaacacacgggctttggctttatcttcgatttggactaaccaacccttattcacatcttgcaataatggatttgaggtacggtttgtggttgttgctgcacttgtgccattccaaccgatcatgatacggtctaatgcaatgcgttctgctttgagtttgcccacacgtgcggcaaaatcagggaatttcgcccaactgtctaaggttggataatttaaatgtgtgtcaaagttggtttgttcgcaagaataggtgttttcttgcaagctgtgaatatcagtggtttcacgtgctttggtgttggtgtcggtgcgacttgccactggtgaaagcacacctaaacgcaatgcagaacctttcatttcttgcaccatcactacattgatgcgtttcaagaaatcagaactttcaagcacagcattttctaatttttgttgaatagttggctcaacggtaaactgaccaccatttgcgataaaagcaacatcttcgccgttatcttgtgcaacaccagcaaggtaagtattaaatttttgtttggtaaatttattcattggttttttcctaagataaattaaaagaagcggccgtcagtttcaggttgttcaccgtaaactaaagggcgaggattttcgggttcaacaggcttttggagttctgcgaacgttgcttggatttctgcattacttgctttcatttcttcgatttcggctttttgtttggctaaatcgtcagaaagtgcggttaatttttccaaggtttctttggtttgctcggctaaaagctcaatggcttgtgtttgatcagaaaagcgttcatcgtctgatttttcttttttcgcaaacaagcctttgattttttcaaagatgctttgtgtttcttccacaaattccaattcagtttcaacggctgcagtgaaaatgttatcggctttttctttgcggttgttgagaggatttgcgcttgcaccggcagaaaataccaacatttctgtgccaagacttgcaggattgtccgttacagccaaaccgactaaataggcttcacctgtgtcagcaaaatttggatcgcactcaatagaggtgtagattttctgacggtctttattgagtttgattaaatcgtccgttgggtcgatttgagccagtaattgcaatttaccttcagcattttcttccgtttttaaaccaatcacatcaccatagcattttgagtgcggatcatcgttccacatataacgccatttaatgtgttcaagattaacgcgtgcaccgtattttttcgggtcataatttgccgccatttctgaaatccagttgcgctgaatagtgcgtccgtctgtggttgcgccttctgtcgccacaaccacccatttagatttttttgccattgcttatcctttggttggtttgattcaatgattgtcgctattctgaaaggtttaattttggtggtctatgagttgcttttgttgtatgccgattcacagagcaagcggaaagactaacattcgccccctttctattatgcggttgtaaatagaaaggattaggaatggacgaacaagttattaatcaaccttcccccgaagtgacagtggaaatcaaacgtaaagcacagcagatgtatttcagtggttataaaatcgctgaaatttcacgccagttaaatactcctgcctcaacaattgccagttggaaagacagagaaaaatgggacgatattgcgcctgttggtcgggttgaattggcattagagacaagattgaatttgctgattgcgaaagaagaaaagagcggttcagattacaaagaaattgatttgctcggtcgccaaatggaaagaatggcgagagtgaaaaagtattcttttggtgacggtaatgaagtagatttaaacccgaaactggcgaaccgcaacaagggcgaacggaagaaagccgaacccaatgccattgatcaggaacaagaggaattgctgataaatggctttcttgatgggatgtttaattatcaacgtatttggcacaaggcgaaagaacaccgcatcagaaatattttgaaaagccgacaaatcggggcgacttactattttgcccatgaagcctttattgatgctttgacgacggggcacaatcagattttcttatcagccagtaaaaaacaagccttacagtttcgctcgtacattgtgaattacgccaagcaaacggcagatgtagatttaaaaggcgaaaccatcaaattgccaaatggggcagaattgattttccttggcacgaactccgctacggctcaatcctaccacggcaatttgtatttcgatgaagtgttttgggtgcctaaatttgatgtgatgcgaaaagtggcatcaggtatggcagcacaaaaaatgtatcgccaaacttatttttccacgccgaccacaattgcacaccctgcttatgcgttcttttcaggcaaggcgtttaatcgcaatcgtgcgaaatcagaaaaaatcgaaatcgatatttctcacgaaaacttaaagagcggaaaactttgtgccgaccgtcaatggaagcagattgtgagtatttatgatgcaatggaaagtgggtgcaatctattcaatattgacgacctaatcgcagaaaacagcaaagaagaatttgaacaattgtttttgtgtcaatttgccgatgataacagttctgctttcaagttttcggacttacaactttgccaagtggatagtttggaagaatggcacgattataagccattttatcaacgtccattcggcaatcgtgaagtgtggttaggttatgaccctgcttttactggcgaccgtgcagcattagtgattgttgcaccgccgaaagtagaagggggcgattatcgcgttttacataaacaaacttttcacggtatggattacgaaacacaagcaagccgcattaagcagttttgtgatgattacaatgtgactcgcatcgtgattgataaaacgggtatggggtcgggcgtttatcaggaagtgagaaagttttatccaatggcgcagggcctagagtataacgccgatcttaaaaatgaaatggtgttaaaaacacaaaacttaattcagaaacgtcgccttaaatttgatagtggtgacaatgacatcgtgagtagttttatgaccgtgaaaaaacgcattactggcacagggaaaattacttatgtttcggaccgttcggaagatgcaagccacggcgatttatcatgggcaattatgaactgcattttaaatgtgccttatggtttaggcggcgatgtatcaagcaacaaatcaacaatatttacctttgaataggataacccaatgagcaaaaaaacaaaaaaatccaccgcactttctactggaaatcaagcacaggcgttcagctttggagagcctattccagtgattgaccgtgcagaagtactgaattatttcgaaagcgtggtgatgtatgaaaaatattacaatccgccaattaatttaagttacttggctaaagcgttaaatgcctcagcccatcataacagtgcgattacggtgaagaaaaacattttactttcaacgtgcaaaacaaccgcacttttacctcgaacccaattagaaaaactggtgcaagattacttggtctttggtaatgcttatgttgagaaaactgtaaattcctttggtaaggttgtttcgttaaaatcctctcttgctaaatatatgcgtgtcggtgttgaaacaggtgtgttttatcagattgtgaatggttttgatgaatatgaatttaaaaaaggttctgtctttaacttgattaatcccgatgtgaatcaagagatttatggtgtgccagaatatttggccgcacttcaatctgcttttttaaatgaaagtgccacattgttccgctgtaaatattatctgaatggcgcgcatgcaggttcgattatttacatgactgatccaacacaaaacaaagacgacattgaagcaatcaaaacacaaatccgacaaacaaaaggcactggcaactttaagaatttgtttgtgtatattccaaacggaaagaaagatgggatgcaagttattccattgtctgatgctatcgccaaagatgatttcctaaacattaagaacgcaagccgtgatgatgtgttagctgcgcaccgtgtgccaccgcaactaatgggcattgtgcctaataatacaggcggttttggtgacgttgaaaaggcaacgcgagtgttttttatcaatgagataatcccattgcaagaacgattgaaagaaattaatagttggataggggaagaagtgatcacattctccgattacaaattgctaaattagatccttttcaaaaataaacagcccgcagaaattcgggttttttttgctaaaagagctgtttttgtcctgtatagtattagcactgtcccagtgtattatatcaaatcaatcaatatgacaaatcttaaatccttatttcagctcgatttttcgcccaattgtacgcatgaaaaatcgcagtcaaaccctcgccacgcccgcacactaaagatgtcgatttcaacgcaattttagatccttgccgaagtcttttcagatctaccgacattcagatccttattatcaaattctttaacgcaaaattactcaagtaaatgcaaattttgatgatataatcattgtccctaaaaggcaaaaaatcatctgaattggcgtcttgttttttatggtagtaagcttggtagtaagctatttttaactatttaatatatcttttaaaaacaaagtgatatttatctagatcagctttccccagcaacgctaagccattgattctaatatgatcaaattgattaatccaatgtcacaatgttctgctggcaagttgaaaatgcctgcaggggaatcaacaatttttactattttgaagataaaactcaatgacttgttgcttgaaaaaaaattgtatttggtcataaaaaatctgcaccttagttggttatttaatccaacttttggagtgcagatcaaaagtgcggccaatttttttagaattcttttgaaattaaactttcggctaattgcaaatcaagtgtggagtcaatatcaatggaacgataagttggcattaaataaaaacgcattggcgcaataaaaaagcgtttttcttcaaagagactttcgatgtcattaatataaattgcgccatttgcacgataagatttgggtaatttttgacgaggggcttcaaaatccgttaattcgtgaataggctgaacttcggtaccttctaaagtgaaggatttataaggatgatgctcacattcgcaagcggaaaccactgacttatatttgccgccaaggaaaatttccattgcattacgaatatctaaagcattacgcaatgggctggttggttgcaaaagtgcagcggtgccttgtgaaatattaagtgtttctaagcaatgcaaaattgcatcaatggtgcgtgtatcactttgcgccaaactttcagggcgtgccactggttttgcgccgtattttgtggcttcttttaaaatattttcaccgtctgatgtcaccacaatttgatcaaacatacccgattcttgcgctgccaaaatcgcacgccccaccaaagaaacaccacccacaagctgtaaatttttgtctttaattcctttagaacccgctctcgcaggaataattgcaattcttgtcattattttcactctctgtgataaaagtgctgactattctagaatctttcccttgttttagcaaaaactaatctttaatatggcaccacatttttgtttaacaaagaggaaataaaatgactcaacttactcgtgaacaagttcttgaactcttccatcaacgcagctcaacacgttattacgaccccgcaaaaaaaatcagtgatgaagattttgaatgtattttagagtgcggtcgattatcgccgagttctgtaggctctgagccttggaaatttttagtgattcaaaataaaaccttacgcgaaaaaatgaaaccttttagctggggaatgataaatcagcttgataattgcagtcatcttgtggtaattctcgcgaagaaaaatgcccgttatgatagtccgttttttgtggatgtgatggcacgcaaaggcttgaacgcagagcaacaacaagccgccctcgcaaaatacaaagccctgcaagaagaagatatgaaattactcgaaaacgaccgcactttatttgattggtgcagtaaacaaacttatatcgcccttgcaaatatgcttactggagcctcagcccttggcatcgattcttgcccaattgaaggttttcattacgacaaaatgaatgaatgcctcgccgaagaaggattattcgatcctcaagaatatgcggtttctgtcgccgcaacctttggctaccgctcacgcgatattgcgaaaaaatcccgtaaagggttggatgaagtggtgagatgggtggggtaaaaatcccattaaaaaagggctgcaaatgcagccctatcttttttgattatttcacttctttaaataaaatctcgcttgggattacggaaccttgccagtaaagttctgtagagactttttctgcaagttgtaagaacgcttgtgaaatttcattttcaggcactcgcacaacggtcgggttgcctgcatctaaatcttcacggatacgaatatgcagaggaagttgagctaatactttcacattgtatttttccgccattttctctgcaccgcctgtgccaaaaatcgcttcgtggtgaccgcacttactacaaatatgcatcgacatattttccacaatgcctaacactggtacggatactcgctcaaacattgaaataccttttactgcgtcaagcagagcaatatcttgtggagttgtcacaaccactgcgccagtcacaggaatttgttgtgataaggtaagttgaatatcgccagtgccaggaggcatatcgataacaagataatctaaactatcccatagggtttcatttaataattggcttaatgcactactcgccattgggccgcgccaaattgttgcactatcttcattcattaaaaagccaatggaatttgcagataaaccatgtgctttaattggggtgatgtgttgattatctggcgaagttggacgttgattcgctgcgcctaacatgtgtggaatagaagggccataaatatccgcatctaaaattccaacacgtgcgccttgtgcttgtaatgctaaagctagattaacagaaaccgatgatttccctacgccgcctttaccagaactcacagcaataatatttttcacaccttttactgccggttgattatttgcacgtttaagtgtggcgatttgataagccaccgcccatttaattgatttacaatctgttgctttcaataacgcatctgaaaccgcttgttttaactgttctgcaccagaattccacgcaaaaggcaatttcaattcaatgcgtaacgtatcgccgcccttttccacttttttcaaagtattaagcacaatcagatccttttgcagagttggatgctgaaattgttgaataatctgctgaacttgattttgctggtcggcagtcaaattatcagaaaagtaggttgccataataacttcctgtttagtagagtaaatttgtcggacatatttaatcacggaaagtgcggtatgttaagttaaagtttttcaaactagaaaaaatcccctatttaaagtaagataagcacaatttttgtatgctaaaaaagagaataataaatgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgctaaagcaaaagccgatcacattcgtgattttgcaggtttcaatattagttttgataactatcattccactcacagcgaagaaaacaaacagctcactgcagaaatttacaataaactcaaagccaatggctttattaagagtaaagttatttctcagttattcgaccctgaaaaaaatatgttcttgcccgatcgttttgtgaaaggcacttgcccgaaatgtaaagcagaagatcaatatggcgataactgcgaagtttgtgcttctacttacagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgcgaacaaaatgcaagaatggtttgagagcggtttacaacaatgggatatttcacgtgatgcaccttatttcggttttgaaattcccggcgcaaaagataaattcttctatgtttggttagatgcgccaatcggctatatggcttcattcaaaaatctatgtgagcgtgaaggcattgatttcaacgaattttgggctgaaggcagtgatgcggagctttatcatttcatcggtaaagatatcgtttatttccacagtctattctggcctgcaatgcttgaaggcagcggctatcgtaaaccgactaatgtgttcgctcatggctatgtaacggtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtaaatacagatatcgtaaacaaattagtgaatttagcttcacgcaatgcaggttttattgcgaaacgctttgaaggcaaactttcggataaactggaagacgaagcattatttgcagaatttaccgctcaagccgagcaaatcgctgcttattacgaaagccgtgaatacaataaagccattcgtgaaattatggcattaacggataaagccaataaatacattgatgaaaaagccccttgggtgattgcaaaagaagaaggcaaagaggcagaattgcaagccgtatgttcaatgggtattgagcttttccgcgtattgatgtcttacttaaaacctgttcttccaaaactggcagaacgtgcagaagccttcttacaagctgaattacgttgggataatattcatcaaccattacttggtcatacccttgcaccgtttaaagccttattctctcgtttagagaaaaaacaaattgatgccgtagtggaagaaactaaagccttatttgccgcagccaataaagcagcagaaaaaacagaagcaaaaccaaccgcactttctgccgttaaacctattgctgaaaccatcacgattgatgatctcgctaaacttgatatgcgtgtagcaaaagtactgaaatgcgaagcagtgccagaatctaataaacttttacgttttgaattggatcttggcgatcatactcgtcaagtcttctctggcattaaagcggcttacaataaacctgaagaattagaaggtcgttttgtgattatggtggcaaaccttgcaccacgtcaaatgaaattcggcgtgtctgagggaatgattctatccgcaggaacaggcggtagtgatttattcttgttatctgccgataatggtgtcaccgcaggtatgcaagtaaaataatcaattcaattaattagggcaacattacgttgcccttttattttcttgttgaaaatagatgacttataacctaccataacactcaactatttatctgtttggagaatattatgaaaaacgaattaatctgctataaacaaatgccagtgtggacaaaagacaaattgccacaaatgttccaagaaaagcacaacacaaaagtcggcacttggggaaaattaaccgtattaaaaggtaagcttaaattttatgagctaacagaaaatggcgatgttattgccgagcatatttttaccccagaaagccacattccttttgttgaacctcaagcatggcatcgtgttgaagctctttctgatgacctagaatgtaccctaggtttctattgcaaaaaagaagattatttcagtaaaaaatacaacatgactgccattcacggcgatgtggtggatgcagcaaaaattatctcgccttgtaaagtattagatttaggttgcggacaagggcgtaattcactttatttaagtttattaggctatgatgtaacctcttgggatcacaatgaaaacagcattgcctttttaaatgaaaccaaagagaaagaaaaccttaatatttctaccgcactttacgacattaacgccgccaacattcaagaaaactatgattttattgtttcaacggtggtgtttatgttcttaaatcgtgaacgtgtgccgtcaatcatcaaaaatatgcaagaacataccaatgttggcggatataatttaatcgttgccgcaatgtccacagatgatgtgccttgcccacttccattctcattcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaataatctgctaatttaaaaaatcaccgcactttgtcctcacccaatattagaaaatatctttagctttgcgaagtgcggtaaattcttcaagtgtttttgcttgtaaaaacggattaatttctcgctcaagttttaaggttgtcggcaaacttggtttattttcagcccgttgtgtttcaacaaaaatacgttgtttttctaccgcacttttttccaccagcacagtttccgcaaatgctaaattccccaaggtatattcatgagctgggcaaacaatcgtctcgtcaggcaatgtattcaaacgctgcaaaccatcaaacatctgcgcataattgcctgtaaaaacacgtccgcaacctgcagaaaataacgcatcaccgcaaaataaatgattatccactaaaaaactaacgtgctgtttagtgtgtccccccgtcggaatgacatcaatttgataatgtgcggtaaggatcttcccttcgttcacaacttgagtcgcaccttttttctcacattcttgcggcccataaatcggcactgttggataacgttttttaaatgccgacacaccttgtgtatgatcctcatgttcgtgagtaagcaacaccgcttcaatcgttgcgttttgcttatctagccatgcaaacagcttgtccgtttcaggcaaatcgacaataataagcggcagattttctcgttgataaagccaaatgtagttatcattcagcgcaggtaaagcaaataacataatcgtccttttaattagtgatagaaaaataaattgattccacttgaaacattagatgcgatccacattccaccaaatcaacgcccattttttctgtccatgaaaaattagttcgttattggcttgtttacgatcgtaaaaggctttcaaaccttgtttttctttttcggacagttcgcctaaagaaaattccaccgaggctaataaatcctcgtagatttcaccttgaaaacaacccgattccgtttcaataaaattcaaatttgcctgaatgcctttttgatacaaccgattgagtaaataaatataagtggggaaaccaatatcttcacggccaattgcctcaaatacgccctcatctaagaaatggcgttgtgtgacagaagtcaaaaacacacgttttttcgctttggcacagagtttttcgatcatatcgtccaaatcgtccaccaacgttgaatgagatgccaacactacatcagcttgtggcacatcatcccaattatccgtccaagatttatgaaatgttgtgagattatgcaaccccaatttctgtttgaactgcgccaagcaatctaacattccattactataatctaaggcatataccgttgaaccttgttgtgcgagcggtacagcaaaagtaccaggcccacagccaatatccaacactgtttcatcggtttgcacattcattgcttgcaataattgctgattatatgctgaaggcttaccgaccaaattttctgccattttcacggcttttttatcccattttgtcggaggtaagttgtaatgatgacaagcgattaagtgttgttgatacagttcagcaaaattgatgtcgtaaatagtcatagtgatttttcaatgtaattattcaaatgttgatgtaaaagtttggacgaagtgcggttaaaatggtaagcgttttttcattttaacttttttaaaaacgagacattacaacaaattctacagcatcgatatattaattcaaatataacgtagcaaaaacaggcaaaatgtttctataatatttaacgttatatatttccttatacagatttatttcgtagaaaaggataattcaatgaaatttgaagtaatttataaatttttcttagtgtggggactagccttaagtttgcttttcgttgttgcaagtggcatttcaatgtggctaggatttccttttagtcaagccttagacattcatcttttctttgctggatttaccgtatttggtttgttactgcatttttatagccgtaagaagaaatgggtaaaaatcaacactcaatttgccgatctcatcacaaataatcgcatgccttcttactgcaatttagatcgcttgatgatgactttcgaacatttctctattcaacaaatcgccgagcaacttaatctttctctcccgattttattaaatgaattatcgcaagctcaaataaacataactgattcccaccgcactttatgcgaaaactttcctctcaacgatgaaaaaattttcgccgcaattacaattgccttaaaagtgcggttcaatccaactttactttaacgccaatcaaatatacgttaaaagtgcggtagaaaaccccgaagtttttcgggatttatttttgccgaaaaaatcttgccccgctattaaaactcccctattattcaccgcacttttttcttatttaggaacaaaaatgacagaacaaacctttattctcggcaaagatgctgcattagaagatagtattgcaaaatttcagcaaaaattgaccgcacttggttttaatattgaagaggcatcttggttgaatcctgtgccaaatgtgtggtctgtgcatattcgcgataaagactgtccgcagtgtttttctaatggtaaaggggcaagtaaaaaagcggcgttagcctctgcccttggcgaatattttgagcgtctttctactaattatttctttgccgatttctatttaggacaagaaattgcaaacggcgatttcgtacattatcccaatgaaaaatggttcccaattgaagacgatgctttactgcctaatggcattttagatgattatttattggattattttgatcccaatgccgagcttacgcctgaattattaatagatttacagtctggcaattatgatcgtgggatcgtggcgatgccttatgttcgtcaatcggacgaacaaaccgtttacattccacaaagtattattgccaacctttatgtctcaaatggcatgtctgcaggcaatacgaaatttgaagcacgcgtgcaaggcttgtcagaggtatttgagcgttatgtgaaaaacaaaattatcgctgaagcaattagtctgccagaaattccaaaatctgtgatggatcgctatccatctattcaggcttccattgcaaaattagaggaagaaggtttcctaatttatgcatttgatgcttcacttggcggaaaataccctgttatttgcgttgtgctactcaatccgaataacggtacttgctttgcctcttttggtgcgcatccaaatttccaagtggcattagaacgtactgtgacggagcttttacagggtcgtagcttgaaagatttggatgttttctctccgccctctttcaataacgatgatgtggctgaacacgctaatttagaaacccactttattgactcaagcggtttaatttcttgggatttactcaaaaaaacgcctgattatgaatttgctgattgggatttcagtggtaccacgcaagaagaatacaataatttaatggcgattttccgtgccgatgaaaaagaagtttacgtaatggattacaaccatttggatgtctatgcgtgccgtattattgtgccaggtatgtctgatatttatcctgcagacgatttaatttacgccaataacaatatgggaatggattggcgcgaaattttactggatttaccaaactggcatcacgatgcagaaacctatcaagaattattagatgaattagacggacaagatattgacgatgcgactcgcgtgcgtgaatttatcggcatcgttgcacctaaaaatagcggctggacaactttacgcgtcggtgaattaaaatctatgctccaccttgcattaggcgaattagaacaggcattagattgggcaaactggacgctgaatatgaacagttccgtatttaccacagaacctgtgaattattaccgcgcattaatttccatcattgaattacatttagatcaaaatcgtgaaccagcgcaatatcgtgcagtgtttgagaaaatgtatggtaaagatgcagttaaacaagcttgggcagctgtctctgaaggtggcaatccgttctacaatcttccagcaagtgatgaaaatttggaaaactttaaggaacatcaggcgttgttgggggcttatgggaagttgcagaaagcaaagcgagcacatcaaaaataaattaggcttatttcgtactttcaattcttgaaagtacgacctacttttctttgcttcgccaaagaaaagtaggcaaaagaaaagcgcccctgcttttccttatttcctttgtttcatacaatttgcttaacggaaattttctaaactcgccgcaagcggctcaaacagacgaaaattgcctgaaaattgaaagtcgcaaaggcgatttatatggggccccgaatttatcagagcattatttaaaaagtgcggttaattttaaattcattttaagaacaaaaaatattttgagttttgaccgcactttaaatcggataaagaacaaattgggttcccttcttttccacctttgtggaattgaatttgtaggaaattttcgtctgtttgagcgcagcgagtttagaaaatttccgtgaaacaaattcaatggaacaaagggaataaggaaaagcagggttgcctttctttttgcctactttttctttggcaaagcaaagaaaaagtaagtcgccatcaggcgaaatcctgatatcaaaaaccacatatccacaattttatgctataatccgccacaatttttgatcaaaaaaggaataccaatgacggattcaatccaatcatctatcacccctgtcaatatcgaagaagaacttaaatcttcctaccttgactacgcgatgtcggttatcgttgggcgtgcattacctgacgttcgagatggtttaaaaccagttcaccgccgcgtactgttctcaatggatcgcgaaggcaataccgccaataaaaaatacgtaaaatcagcgcgtgttgtgggtgatgtaatcggtaaatatcacccgcatggtgactcagccgtgtacgataccatcgttcgtatggcacaaccattctcacttcgctatatgttggttgatgggcaaggtaactttggttcaattgatggtgatgcgccagctgcaatgcgttataccgaagtgcgtatgcaaaaaattacgcaagcattgctcactgatttggataaagaaaccgtcaatttctcgccaaactatgatggcgaattaatgatcccagatgtattgccaactcgtattccagcacttttagcaaatggttcttctggtattgcggtggggatggcaactaacattccccctcacaacttaaacgaagtattaaatggttgtttggcttatattgacaacaatgaaattaccattgatgaattaatgcaacatattccgggcccagactttccaaccgctgcattaattaatggtcgtaaagggattgaagaagcctatcgcactggtcgtggtaaagtttatgttcgtgctcgtgcaaccgtagaaaccaacgaaaaaggacgcgagcaaattatcgtgtctgaattgccataccaagtaaataaagcaaaattagtcgagaaaattgccgaattaattcgcgagaaaaaaatcgaaggcatcagcaatattactgacctttcaaacaaagaagggatccgtattgaaattgatattaaacgtgatgcagtgggggaagtggtattaaaccatctttactcactcactcaaatgcaagtgacctttggtatcaatatggtggcattggatcacggtcagccacgtttatttaatcttaaagaaatcattgaatccttcgttttacaccgccgtgaagtggtgacacgtcgttctatctttgagcttcgcaaagcacgtgaacgtacgcacattttggaaggtttagcggttgctcgttctaatatcgatgaaatgattgcaattattcgcaactctaaaaaccgtgaagaggccgcaacagcaatcagttcacgttcttggacattacatagcgatattattaatcttcttgatgtttccgctcgtcctgatgagttagaagaaaatcttggtattcaaggtgaacagtattacttatcgccagcgcaagtaaacgcaattctagaacttcgcttacaccgtttaacgggcattgcgtttgaagaagttataaaagaatatgaagaattattagttaaaattgcggatcttcttcatattttaagtagcgcagaacgtttaatggaagtgattcgtgaagaattagaagaagtgaaagcacaatttggcgatgatcgtttaactgaaattaccgctgcttctggcgatattgatttagaagatttaatcgcacaagaagacgtggttgtgacgctttctcacgaaggttatgtgaaataccaaccactgactgactatgaagcacaacgccgtggcggtaaaggcaaatctgcaacgaagatgaaagaagaagatttcatcgaaaaattactggtggcaaatactcacgataccatcctctgcttctctagccgtggtcgtttatattggttgaaagtatatcaacttccacaagcaagccgtggtgcacgcggtcgtccaattgtgaatattcttccgttacaagaaaacgaacgtattactgcaatcttgccagtttctgcttacgaagaagataaattcgtagtcatggcaactgctggcggtattgtgaagaaaatcgccttaaccgaatttagccgtccacgttcaaacggtatcatcgcattgaatttacgtgacgaagatgaattaatcggcgtggatattactgatggcagcaacgaaattatgttgttctcatcgcaaggtcgcgtggtgcgttttgctgaaaatgccgtgcgtgcaatggggcgtttagcaacaggtgttcgcggtatcaaactggctttaacaaacgatatttctgacgatgaaagtgcggtagaaattgaagatattctgatgacaacgctgaagcatcattagacttaaatatcgataaagtggttctctcgttgtgccaaaaggtgaaggggaaattttaacagcaccacaaaacggctacggaaaacgcacacaaattaagtgaatacccaactaaattcacgtaatacaaaaggtgtgatttcgattaaagtgagtgaacgcaatggtaaagtcgttgctgcaactcaagtagaagaaacagaccaaattatgttgatcactgatgcaggaacgcttgttcgcacacgcgtaagcgaagtgagcattgtagggcgtaacacgcaaggtgttcgcttaattcgtactgccgatgatgaacacgtagtaagtttagaacgtgtttgtgatgcagatgaagaagattctttggaagaaagcagttctgaagaataactggttataaaagaagaagtgcggtgaaatttcaccgcacttttttatgactaattaattacctgccaaaccatctcgaattcgtttttcaaactgatcataatccactaaaaacgcatcgtgtccgtaatctgatgggaattcataaaaatgtagatcgactccactttgctctaaaagctgtttacttttataaagatcaatgggtttaaaaagttgatccgttgtcacagaaaccaacgtatagcgtgctttaatacgtgataatgcctctttgacattctcataccccaaacttggatcatacatatccaacgcacgtaacaaatgcaaataactattggcatcaaaacgttctaagaattttttgccttggtaagaaagataggattccacttgaaagtaatcgccccaaaagctgccatctgattttgtagcacgcccaaaggctttggctagttgtaaatcggtgcggtaagtcagcatacctagcatacgcgcaatagataacccttgatctggcggtgtcccctcataataatcgccgccgttaaaattgggatcattaattaccgcttgacgcataacatggttaaagcctatggcttcagcactaaaataaatggatgagcaaagattcacgatattatccataaaatcaggataatcaatcgcccattgattcgcttgcataccgccaaaagatccaccaataatggcttttaaatggctaataccaagatgttcaagcaaggctttttgtactttaacaatatcttgcacaacaatattaggaaattggctgccataaggtttacccgtttgcggattaattgatgaaggcccagttgttcccttacacccacctaatacgttcgagctaataaaaaaataacgatccgtatccaatgctaaacctgctcccataaaattctgccaccagccatctcgaccatcatcgaaataaggctcagcatcgccagtcaaagcatggcaaattaataccgcattatttttttcggcattgagtgtgccataagtttgatacgcgacattaatatgggaaagtttgccgccaagcatcagagttaaaggctgtgtgtcaaaaagcactacattttgcacagacattgaaaacctatcgtaataatcagaatggcgtttaaactatcagtaagtcgattagcttgtcaagaaattttagccgtctaaacggctaaattatcgcacatcaatgcgattcacaaaatccatcaaattctccttgaagtgcggtcgatttttcattatgtttaccgctatgctagtaaaaaaattatctccaaaattcaccgtactttttcgcgcactactctacgcaatctttgcattgattatactttgcttgctagtggatcgaggcgtcagtttttatgttcgcgataaaatattcacaaatattgatgaactcccctttcgcccctgcgcccttgtgcttggcacatcaaaatacaccgtcagcggaaaaccgaacgtttattacgatagtcgcttaatggcagctaaaagcctaatcgaacaacaaaaagtgaattatcttttattaagtggtgacaaccgaactttgcaatataacgaaccaagagcaatgtttcgcgatttacgcaaaatgggcgtgccagaaactttaatgttccgtgattttgcaggttttcgcaccctagattccgttatccgcgccgataaaattttccaagtgaaaacatttacgattgtcagtcaaaaatttcattgcgaacgcgcgctattaattgcccaagcacataatattgatgccatttgctttgtggcaaaacagccagaattacatttttccacacaaataagagaagtttttgcccgcataaaagcggtttttgacttgatattaggtgttgagccttattttttaggggaacctcagccattgccaaacagcaccacattataaatattgttctaaatcatatttcttctatttttctaaaatcacactaatctaaacttgttaaataaacacaaactggttaaaatccaaccgataaggaaaatactgttttatgctaaagggtttactttaattgtcgttgaactcacaattgatataaaagataaaacagagaaaaaaatagtcacaaaggttaccaaggcaccgtgggtgtgaaatattcttggaaataatattccaaaaaataagggctgattttaaatatcagccctttgctttgatggtacattttattccaccacagcccaaaattcagcaacggtgtggaaagatccaaagactaaaaccacatcattttttaccgcacttttgagtgctgtacacacaccatccataacagaattatctgatgtagcttgaatatttgggaaatgacttttcaatttctctgctaattcatcgcctgactgcccgcgatagccgcctaaagttacacaatgccattcatcaataataggtgttaaatgctcaaataccccatttgcatctttgtctttgagcatcccacacacggcaatcattttaccctcgatgctacgtttaagtgcggtcaatttttcagataaatattttgcagcgtgaggattatgccctacatcaacgataattgttggcaaggtttcaactggtacgccaagataatccgctaatttttcacgtttatctgtttttatagcttgaaaacgaccaaccagttctacctcttgcaaagattttcgcaaagtctgttctgaaaattcaaaaggtaaatattgaacggcagccagagccgttgcggcattcgccaatggaatctgacaaaacggcaaattttctaaccgcacttttttattttgccattgccaattttcagcatttttgctcaaataaccaatccccatcacgacgagcaactaggcaatgtaatttttcggcctgatctaacattgtttgcggcacattaggttcaccaatcacgacagggcaattttcgcggaaaattcctgctttttcaaaagcaatggcctctctggtatccccaagaaaatcggtgtgatcaatatcgatgctagtaatcacagcaagatggctatccacaatattggtcgcatctaaacggccgcccaaacccacttctaaaatcaccacatctaattttgcttgcttaaataaatgcaatgcagaaagggtgctaaattcaaaataagtcagcgattctgttttgttttcatcaataaaagcaaaagaggcggtatgtgcttcatcgggtaaatcttgattttgaatgcgtactcgctcgttataacgcaataaatggggcgaagaatacacgcctacacgtaatccgtgattaagcagaatcgtttctaacaagcgacaagtcgtgcctttaccattcgtcccccccacagttatcacataaggggcgggatgaagtaaatccaatttttctgccacggattgaatacgatctaaaccgagatcaataggtttaaaatggcttttttctaaataagaaagccactcagcgagtggcgaagtggctttaagttgcatattattcatcttctgaaatgagttcaggttctacaaaaggagaaggttgattcgttaatttactcagtacacttgctaaagtttgacgcatttctgaacgtttcacgatcatatcaattgcccctttctcaagtagaaactcactacgttggaaaccttctggcaatttttcacgcacagtttgttcaataacgcgtggccctgcaaaaccaattaaggcttttggctcggcaatatttaaatcccctaacatcgcaaaactggctgatacgccgcctaaagtcggatccgttaatactgaaataaatggcacacccttttcacgcatttgagcaagtacggcactggtttttgccatttgcattaaagagaataatgcttcctgcatacgagcaccaccactcgcagagaaacatacaaacggacaattcatttccatcgctttttcagccgctttaacaaattttgcaccaactacagaacccattgaaccgcccataaaagcaaagttcgatgcagccacaacgattggcatattataaagtgtacctgtcatagtaattagcgcatctttctcgcccgtttctttttgcgccgcattgatacgatctttatatttctttaaatctttgaattttaaaatatcttttggttctaaatctgccgcaatttcttggcttgaatcttcgtccaataaatttaataaacgctcacgagcatcaatacgcatatgatgaccacatttcgggcaaacatacagattacgtttgagttcttcactataaagtacttgttcacaagcagtacattttgtccacacgccttctggcacattggcttttcgagtggaagaagaaggacttttactaaaaattcggttaatccagctcattttttgacctttttattgactagaaaattgcgcgtattagaacataaatttatagaatttgctacttgtaagaccgtttttgtactgctccgatttccttttaaacaagataatttgctctcctcttattgaacattttttttatttttttgtcttacagaccacgttatctgaaatttattttggagtatttatgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccgtgcaattacaagatgggcgtgaatttaaagcaaaattagtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaatttctatttattagtgcaataatctgcttgatatatttaagaaaaaagtccgatcacaatgatcgggcttctttttatgcagcaatcgttcttaacaaatccaccacaaattctaaccgcactttgttatcggatagatctttcataaacttaaattttaatgggccatcaaatcgatacacaataggttctttttgaattaattgaataaatttatctggattcacttgtgcttttgctgaaaactcaataaaaccgccttgtgttccagcatcaattcgcacaacgttcaacggctcaaccaataaacgcaactctgtaatttgtaataaatttttcgttgcatcaggcaataatccaaatctgtcaatcaactcaacttttaattcatctaattctgctttactctctgctgcagcaatgcgtttataaaaggataaacgcatattcacgtctcctagataatcatcaggcagtaaagcaggcacacgcaattcaatatccgcttgttgttgcgtcaattcttctaatgatggttcacgcccttcttttaacgctttaaccgctgcatccaataattccatataaagcgaaaaaccgatgctttcaatttgtccactttgttcgtttccaagtaattcgccagcaccacgaatctctaaatcgtgggttgccaagataaaaccagccccaagattatcaagattttccaacgcatctagacggcgttcagcatcttttgtcatcattttaggtgggggcgtaagcaaataagcataagcctgatgatgtgaacgcccgactcgtccacgtaattgatgcaactgagccaaaccaaaatgatccgctcgttcaataataatggtatttgccgttggtacatcaatacccgtttcgataatggttgaacaaactaagacgttataacgctgatgataaaaatcactcatcacacgttctaactcacgttctctcatttgtccgtgccccacaattactcgcgcctctggcacaagcgtggtcagtttttctgctgtattttcaatgcttgcgacatcattgtggagataataaacctgcccacctcggagaatttcacgcaaaatcgcttctcgtacaacaagatcgccattctgacggacgaaggttttaatacttaatcggcgagcaggaggtgtggaaataatggaaagatcacgaatgccattcatcgccatattaagcgttcgaggaattggcgttgccgttagcgtaagaatatcgatattcgcacgaagctgtttgattttctctttttgccctacaccaaaacgatgttcttcatcaataatcaacaatccaagatcgttaaattttacatctgattgaattaatttatgggtaccaattaatatatcgacttttccttctgcaaggttttccagaatttgtttttgttcttttgcagttttgaaacgcgataacacttcgacattcacaggcaaattcgcaaaacgatctttaaaattctcataatgctgttgggctaacagtgtggttggcactagcactgctacttgcttatgattcatcacagccaaaaaggcagcgcgcattgccacttcagttttaccaaaacccacatcaccacaaacaaggcgatccattgccttaggctgacacatatccgaaattaccgcattaattgccatttcctgatcgtaggtttcttcaaaaggaaaggttgcggaaaattgttgaaattcttcacgatcatatttaaaggcaaagcctttcttcgcttcacgttgtgcgtaaacatctaataactctgccgccacatcacgaattttctccgcagctttttggcgtgatttcgcccaagcctcgttccctaatttatgtaatggcgcactttcatcagagccaccaacataacggctaatcaaatgtaatgaagtcactggcacataaagtttcgattcatttgcataatttagtagcaaatattcggctttaatgccgcctgtatctaaggtgaccaaaccgccataacgtcccacaccgtgatcaagatgcacaactggttgccctattttcagttcggcaagatttcgtacaagcgtatcaggattaattgttttacgtttgtctctagaacgttgttgaatgcgctcgccaagtaaattagcttcgccaataatcgcaacaggaagcgattgttcaattataaaaccttgttcaagagagctgactaacaagctaaatttttcattttcaatctgttctaaagattgaatttgttttggcttgagttttaacggtgaaagcaaatcaagcaaagtctctcggcgaccttccgtctccacagaaaacagtacatttcctttaaaatgctcaataaattgacgtaattgtcccaatggttctttttgctgggattgaatagtcacttctggtagagcggcaacaggtaaatttttctggcgtaccgatgaccgcactttttccgctttaaatgtaatacgtggataagatttcaatcggcgattgacttcatctacattaagccataatttttcaggcgataaaagcggacgcatcggatccactttacgttgttcataacgctgtttggcatcttgataaaaacgctcgccttgcgtttgattattttccatatctacaaacagcgtttgctccggcaaataatcaaataaagttgccatttcagcaaagaaaagtggctgccaatattcaatgccagaaatcaaggtacctttactgatttgctgataaatatgttcgggatctcggcgaatctccccaaaagtttcacgaaattgcgcacggaaaaattcaatccctttgtcgtccgttggaaattcgtgagctggcaaaagattaattgagttaatttcatcaagagtgcgttgcgtatccacatcaaaagtgcgaatagaatcaatttcatcatcaaaaaaatcaaggcgaaaaggcaccgcacttcccattgggaaaagatccaacaaggaaccacgaactgcgtactcgccgtgttctaatacttgctccacagctcgatagcccgctgcttctaattgtaagcacattttatcgatgaccaaacgatcgccttttttaatcagaagcacattgtgttgtaaatattgtggcgggcaaaggcgttgcattaatgtcgaaatcggcaataagaaaatgccttttttcgcattttgtaaatggaaaagcgcacttaaacgagaggaaataatttcttgatggggagaaaaagtatcgtaaggtaaggtttcccaatcagggaaaaggcatacattttgactgcttaattccgataaaacacgtgataaacgcaccgcacttcgtgtatctggagtcaccactacggttaaattttggttttgctctgcaatttcactaatcgccaatgcatcagcgcctggtaatacattgcctaaaattttgtgatcattgggttgggttggaatatcaggttggaaaaaagccgttttcataaatataaataatgcgtcaatcttgtgtaaaattgaggcatagtgtactggaatttgctctatctttcaataagttcactgtttaaaaaaacagttaatatttatttctttaaagaagattcttttgtcttcaaattaccattttcatcttctgttgctgacataggcacgcagctacaattcggttgatctaaaccccattctttaatgaagttgtcatatttttcaagtgcgcgtttaaaccagccttttggttttgcggtttgttctgtcataaagttcctcgctctaaatattgtttaatttctaaacgcaaacattctacgccttttttcttgttaataggaagttgtttttttgttaaataagcggaaattaatgggaaattttctttgcccgctaattttaataaacgcctcatcgcaggaacgctcgaaaataaagtgcggtgaaaattagcgaagttttttaagctcatccaatcaaaatcatcaagctgccaatcaagctgattttgctcaaaatttatggcaaacggatgaaaagataaagggagattacgctgaaattgtttgtacgcagtatcaactaaagccaagccttctttggaaagtcctttaagggcaatcgctgaataacaaccactactcgcttcttgatgctcgcctaaatgcaccaaaacaaaaccgcacttttgccaaaattttgccagttcgtcggtgtagccaaaactcactgaaagaaaatccacatcggcattttccatggcttgcatcaaattttgcccaatgcccttttgctgccaatttggctgaaccgctatacgagaaatacgtaaagatcgtaatttacaggcttgaggcaagttttcatagaaacataacgcctgtggaacaagattccctttcgggcggcgtttgccttgttgaatttgaataatcaactcatcatcagccatatttccttcttctaatgcccaaattgcaccgagcaaattctgttgatattcggcaaaataaaaacgttgattttctccatcaagtaaacggcgaagatcgagtggcgatgttcgataatgcgccaatgtcgttaagccataaaaatctcgaaataaaaattgacgattatattttcctttactacccttacttgtgaggggagcttccaaagcttgagggaggctggctatatctaaatcccccttccgcccttcgggcaccttcccccgcaagcaggggaaggaaagatttttagcgttttcctctatgttataagtaatattgttatagtcaaagtgctgaaaatcatcttcggcatttagcaacaaaagatcatcaataaaatgttctaacgggtcattttcttgccaacgtaggggctgtttaagctcaaaatgctgaaaagtgcggtgaattttccgtttaaattttaattcgaaaccacgccccgtaccttcatagctatgaattgttgtgctgaagacaatatgttgaaaatattgagaatattcttgcaataacggcaatgggattaccgccgcttcatctaccagcaaccaagctgattgactgaattctggttcatgttgtaaccgaatagccagttcatcaggcgcgataaattctatctctcgttctgaaaattcaataacggaatgcaccgcacttttattcggtgcggtgagataaactggtgcttgaatttggttagcaagcatacccaataatgcggattttcctcttccccgcttggaggttagaaaataaatatcctgctcggcttgtaaaatagtctcgataatttgttgttgcgctaacgtagcatttttgtgatgttcgttagaataaaaaaccgtaggaaattcaaccgcactttcctctcttaaaatggggaaatgataacgttcaatgcactgtttgaaatgatcaataaaattaggcgtggcgattgctgactgatttccattccaacgtaaactatcttgatcaggctgctgagataaattttcccaatcagataacactaaacaaagtgtgccgcccattttcagtgttccagctgcaatagccagcgcttcaagatgaatgccatttcgcgcatcaaataagatatgttcaaattcttgtccaagcaaattcgttgctttagaaaaagcaatgccactttcgccgataattaatacgttatcaggcacaagcggcaaagttttgcagattaaaatttgaagctggcgagatgacatcgttttattttaaataggcaattaacatcgcaccaataaaacttacgcaagcaagccaaaagaaaatgcttttgggttgagaaacttttttactgaaaaattttgcagcaaacacaatatacaaaatcagtaatgcgaatttagccactaaccaccattcaataccaaaagcaaagaggtataaaatgacgacgccagacacaatcagcaaggtatctgataagtgcggtaaaatttttaataattttatcgaacgccaatttttaccattaagctgcattgcaccacgaattactaacaatgccaaacttaaaaaggcgaaaaaaatatgtaaatcaactaacataatcactcccaaaaaagtaagaaaagtgcggtcaaaatccaccgcactttctcaatctaaattacttcgcaatacgtttatatttaatacgatgtggctgagtggctgcatcgcctaaggttttctttttccactcttcgtagtctgagaagttaccttcatagaacgtgactttaccttcatcgccgtagtctaaaatatgcgttgcgatacggtctaagaaccaacggtcgtgcgaaataaccattgcacagcctgggaattctaagatcgcattttctaaggcacgcaaggtttcaacatctaagtcattggttggttcgtccagtaatagcacgttaccaccacgttgtagaagtttcgctaagtgtaaacgaccacgttcaccgcccgataattcccccacacgtttttgttgatctacacctttgaagttgaaacgccccacataagcacggcttggaatttcaaagttgccgatagtaagaatgtcttgtccattagacacttcttcccacacagttttcttgtcatccattgagtcacggaactgatctaccgaagcaagcacaacggtttcgcccattgtcacagaacctgaatctggttgttcttgacctgacaacatacggaataaggttgatttacctgcaccgttcgctccgataatcccaacaattgccccttttggaatactgaatgataaatcatcaattaaagtgcggtcgccataagacttggttaagttttgcacttcaatcactttatcgcctaagcgtgggccaggtggaataaagagttcgttcgtctcgtttcgtttttgatattcgccagagttcaattcatcaaaacgagccatacgtgctttgcttttcgcttggcgaccttttggattttgacgaacccattctaactctttcgcaatggatttttgacgtgcgttttcagttgcttgttcttgttctaaacgtttctctttttgctctaaccaagaagaatagttgccttcccaaggaatgccctcgccacggtcaagctctaagatccaaccagccacattatctaagaaataacggtcgtgagtgattgctaccactgtaccctcgtagtcgtgtaagaatcgctctaaccacgccacagattccgcatctaagtggttagttggttcatctaacaacaacatatctggtttttcgagtaataagcggcaaagtgccactcggcgacgctcaccaccagataaatgttcaattttggcatcccaatcaggtaaacgtaacgcatctgccgcacgctctaattggttatctaaattatgcccatcatgcgcttgaatgatagcttcaagattggcttgttctgccgctaatttatcaaaatctgcatcaggatccgcataaagcgcatacacttcatctaaacgagtcagtgcatttttcacttcagaaaccgcttcttccactgcttcacgcacggtttgttgtggctcgagttttggctcttgcggaagatacccaattttaatacccggttgtggacgagcttccccttcaaactctttatctacgcctgccataatgcgtaaaagagtcgatttacccgcaccatttaaacctaaaaccccgatcttagcaccagggaaaaagcttaaagaaatatctttcaaaatatgacgcttcggcggcactactttgccgacacgatgcatcgtatacacaaattgagatgacattaataattcctcacaaaaaaattcgccctattctactggaaaatagggcgaaaatataggaaacaagtggacagattttgcaaaagtttggcgaaacctaaccacttgtcaatatttagagtgaagtattccctaaattaaatagacactttagggctcaaattacattgcaaatgtagaagtatcatgccgatgtagagcgggcttaacatttgcaagactttgttgaaaacgtttattgtgttcaaggtcccataaatcaatacgtgtttgcagattaagccaaaactcaggcgtagtatcaaatactttagcaagtttaactgccatttctagcgtaattcgtgaactattattaacaatattgcttgccgtattacgatgtacatctaaaatttgagctaaatcactaattttaagacttaaaggttctaaaaactcttcttgtagaatttcaccaacagaggtgggttttctcgtcatcatattatcctccttacaaattataagaatgtggatctaaatataaattatttacttcgttattttcatatttaaaaattaaacgatattgtttattcactcgaatagaataaattttattttcttttggctcaagcaactccaaatggttagctggtggagaacgtaaatcgttgatattttctgaggcacttatcatatctaattttcttgccaatactttatacaaattagaaggaatcttactatgagtatcaccatattgataaaacctataaagataatcatctctaaaatgctcacgctttaaattaaacatctattattctcttagttatactcgagctgatcataataagaataaatgcacaatgcaagagtgcatctttcgacttagataaaaaaaaccacccgaaacgggtggcaggaaagtagtttagctatatttatcattattttatttaggaactttatgaatatcaagcaatcacttgacgggagctatgttactgaatattgaaaggcaagggaaatgctattgagagtttttttgatttacatcaacatttttgacagaaaaattcgtttttgcgtgtagaataaacaacttcaaattctagcgttcaaaataataggattttttgtgaaaacgtattcattattactcggtttattcattagttttggtgttttagcccatcctcacgcatttattgatatacaaaccacgcccattatagaaaataatcaactcacaggtttttcaatgaaatggacgttggatgaaccaagttcgtctgcagttatttatgatatgaaacaagctagaactaaagcggaaaaacaaaaacttcttgatgatgtaatgggaaatatcgtcagtgagcattatttcagctatctatatgatgcccagaataataaaatcaaatattcccctcgcccaaaaaattacggcattaatgttcaaggcttacaactgcaatattattttgatgtgccactcgcccatccgcaaaagttagaaaaaaacacatttagcttacaaacttacgatcccacttattatgtggcgatgacttacgcttcaaaaagtgcggtagatttttccgcactttcgaaaaattgccaaggaaaattaattgaacctaatgtggatgaaaaaatccaagcctacgcatcttcacttgataaatcccaaaagaacgaagatgattccttaggcgtaatgttcgcgcaaaaaataataattcaatgtgagtagaaatgaaaaaatataaaactgggctcgtgttattagtgattgcactcgccttacttgtctatttttccccttggtttttcttacatattgccagttggcaaaaagagtttaatcagcttatttcggaaaatttacatcaaattcaaaataatagcatcaaggcaggcatcacacttattttcgtcagctttatttatggcgtactccatgccctcgggccaggacacggcaaatttattattgccagctatctttccacgcatgaaagccaattaaaacaaagcactatcttgagcttactttcatccttaatgcaaggcattgtcgcgattacagcaacaacattgcttgttgtagtgctaaatctttcatcacgttatttcaaattaagccagctttggttagaacgaactgccttgctattattggtatttctcggctgttattggatttggcaaggtctacgtgcctatcgtaaaaaagctaaattaaccattaaatccctcaatcccctccctctacacgaaaaaagtgcggtgaaaaataaccgcacttttcagccaaacacttgtagctgtggacaccaacatttgccaagccccacgcaaactgcacaagcaaccaatctaaaatcacaattcctcgtgattctaacaattggcatgcgcccatgtagcggtgcaattttcgttttatttttagcttatatgcttgatctttatagctggggaattttagctgtattagccatgtctttcggcacggggcttatgctgtcagccttcgcaggaattgtacgttatgcacgaaataccgcaatccacttagggcattggtatagttcaaaaaatacgaaaggaaaaagcgaaagcatcgtgaaactaatcgctggtggaataatgctattttttgccttgagcttgttatacggcacaaccatctcaactggcggaagcaaaatcctattttgaagttaaaaataaagcccatcaacatgatgggctaaaaatcttttggttgctaatttagaatttgtaaaaggagacaaacaaactctaaaccaaaagaaaaattggctcctcctgctggacttgaaccagcgacatatggattaacagtccaccgttctaccgactgaactaaggaggaataaactttgtatcacaaggaacagggcgcgaattttaatgatcgatagttagcttgtcaatgcaaaatttaaaaaaatttcataaaaaaataaaaattttctcatcttttatataccccctaatatttatttttctatccacagagcctgtggataactttgtggattaactttttaaaattttgcggatcccttgttcttacaaggattattcgatcttgattatagattagcctaaaattaaattttgatttaaaatcaataagttaagttttgtctagtaaaaatttaaagtttttttaatgaatttgtgacatcttcctcttgacatcgctaagtctgtgtaaaacttagatttttgcctgatcaattttacacattaaatatgctaaaatagacattattcaaaactatcaaaaaaccgaccgcactttatgtctgaaaaaatcaacacaaaaccgttcattctacattccgactttcgtccctctggcgatcagccacaagctatcgaaaaattggctgaaaatttaacggatggtttggcgcatcaaactttgctcggggtaacaggctcggggaagacgtttactatcgccaatgtaatcgctcaattaaatcgacccgcaatgttacttgcgccaaataaaacccttgctgctcagctttatgcagaaatgaaagctttttttccagaaaatgcggtggaatattttgtgtcttactatgattattatcagcctgaagcctatgtgcccagcagtgatacatttattgaaaaagatgcgtctattaatgatcaaatcgaacaaatgcgtctttctgcgacgaaatcttttctagaacgtcgagataccatcgtggtggcttccgtttctgcaatttatggtttgggcgatcctgatagctatttacaaatgatgttgcatttacaacaaggtgccattatcgatcaacgccaaattttagcgaagttagcggaattgcaatatacccgaaatgatcaagcatttcagcgtggaactttccgtgttcgcggagaaattattgatatttttcctgctgaatccgatgatcgtgcggtgcgtattgaattatttgatgatgaaatcgagcgtttaagtttatttgatccgctcactggcagtagttttggtgctgtcccacgttttacgatctatcctaaaactcactatgttacgccaagagaacgtattttagatgcgatagaaaacatcaaaaaagaactggtatcacgccgtgaatacttcattaaagaacataaacttttagaagaacaacgtatcagccagcgtacccaatttgatattgaaatgatgaatgaattgggctattgctcgggaattgaaaactactctcgctatttatcgggaagaaatgagggcgaacctccaccaacattatttgattatatgccctctgatgccattttaattattgatgaatctcatgtaactgtgcctcaaattggtggaatgtatcgtggcgaccgttcacgtaaagaaaccttagtcgaatatggtttccgtttgccatccgccttggataatcgtccgttacgctttgaggaatttgaacgcttagctccgcaaaccatttatgtttccgcaacaccagggccttatgaattagaaaaatcaggcactgaaatcatcgatcaagtggttcgccccactggtttacttgatccactcattgaaattcgtccagtgtcaattcaagtggatgatttactttccgaagctcgccaaagagcggataaaaatgagcgagttttagtcacaacactcactaaaaaaatggcggaagatttaacggattatttggatgaacacgggattcgtgtgcgttatctgcattccgatattgatactgtggagcgagtagaaattatccgtgatttgcgtttaggggaatttgatgtattggttggaattaacttattgcgtgaaggtttagatattcctgaagtgtctcttgtggcgattttagatgcggacaaagaaggatttttacgttctgaacgctctttgatccaaaccatcggtcgtgctgcgcgaaacttaaatggtaaagcaattttatatgcagatagcatcacaaaatccatggaaaaagccatcaccgaaactaatcgtcgtcgtgaaaaacaaataaaatacaatgaagaacatggcattgtgccacaagcattgaataagaaagtcggtgaattattagatattgggcaaggtgcaaaccaaaaagcgaaagccaataaacaacgtggaaaaatggcggcagaaccaaccgcactttataatgcaccgaaaaatgccaaagaatatcaacaacaaatcaaaaaattggaacaacaaatgtataaatttgcgcaagatttggaatttgaaaaagccgcagcaattcgcgatcaattacatcaattacgtgaacaatttgtttttgataactaaaaaaacgccagcttaagctggcgttccatttatttattttcacctgaagaatacaagcgatttttatataaataactacctaataaagcgtgagccaatgcctcttttttcattgcatcaggtacgtcttttggcgttaaagtttctgttgatttatcataatgataaccttgcgctgctttatttgacatttgaattaccacatcattattgcctttcatcattgcttgagtttgatcgtattgcataaaagcacgatctgggtttacatcttgcgttaaatcaaaaccaatcattggataattgccacttacgccagctaaagaaagcaatgtagttggcatatcaatttggctcacaagacggctatcacggcgtggcgtaatgccatcaccaagaatcaaggctggaatatggaaatgcttaatcggcacaagacttgctccgcctacacgagaatcgtgatccgcaacaattaagaaaatcgtatctttccaataattagactgttttgccattttaaagaaatgacctaaggcataatccgcatattttgctgcgttattacgagtggcttttggttgctcataaagctcaatcttgccatctggatattcaaatggatcgtgattgctggaactaaacactaaactaaaaaacggtttaccttcattttgtaatttcgtgaaagtttcattggctttatcaaataaatcctcatcactcacgccccaagtgccagtaaattttggattctgatagtcttgttgatcccaaatatctttaaagccattaccgtagaaaaaactcgccatattgtcgaagtgcttttcgccaccataaataaacgaagtgttatagccttgtttatgtaataaatccgcaatagtaaagaaaccactttgggcattattaagtttcaccactgcacgagctggtgttggcgtaaaacctgccgttgttgcttcaataccacgtactgaacgtgtgcctgttgcataaagattttcaaataaccacccttcttttgcgagctgatccacatttggagaaagtggtttgccaccaagtgttccaataaactgagcaccgagactttcttgtagcaaaatcacgatatttttaggtttaccctgataagtcgcgacatttttcgttaaagttgggtatttatctgaaatgtaatcactttctggacggccacgactggctttaacaatacgaaaaatttcatctgcatccatttttccgtacatttctgaagatttttcttcatctttaaattgctgtgccgcataaatcacggaatagccagaattaagcaccagagaattcactaacgcatcagaagaaaatgccaccatagcgggatttataccacggtgttgaaaacttgaacgtgccccaaggaagctcaagacaatcacaagcaaagcaatcacagggcgaagtttccaactgattgaacctaaatttttgactgcccaaccagaaattttccaataaatcacggcagctaaaatcgtgaaaacaaggctaaaaattaccgcacttaaatgtccttccgcaagcattgaaaaaacttctttcggataaatcaagtattcgataaataaacgatttgggcggtaatcgtaggtttcaataaaggcaggtgtggcaatttccataaagataataaacacactaccaagggttagccaaaggcgtaaaatttttacccaaactttactgctatggaacaatgttgtgagcaatgctggtacgccaaataaataacaaagtgccacaacatccattcgtacgccttgcaaaaataattgcaaccagccatctacggcggatacacgctctgattgccacacagcaagtcccaaacgggataaggaaaggatgatgagattaatcaacacgaatgtgaagatggggaataaaggaaaatgtgcttttttcattgtaaaaaccactaacacaacgacatccaagccgtattaaattaaagaaagataggcaactgtctatcggtcggttccttttcgacacaacaaaagtcttaaagtgcggtcaattttcgcatagttttactcaatctcaaatgtaaacacattcactagaaaataaagcctcgagaaaaatcgaggctttgttaagtaaacgacggaaatttaataaaaattcaccgcactttttttcgattactcttgttgtgctttcactgctgcataggcaatcatattgataatacgacgaacagatgcacctggattaagaatatgcgcagatttattcatacccattaagatcgggccaacggtaattgccgtagtggtgctgcgtaataagctataactaatacgtgatgcactcaaatcagggaacactaataaatttgcgcttcctttcaatgggctatcaggcatgacttcttttcggtgagcttcattcatcgctaaatcgccacgcatttccccatcaatcattaaatgtggattgcgctctttgacgatttgtaatacttcgcgcatttttggtgcgcctaatgaatcagacgaaccaaaattagaatgagaaagcaatgcaactgcaggttcaataccaaaacgatgaatttcttctgctgccattaaggtaatttcagctaattcttctgctgtaggattactgtttacgtgagtatctgttaagaatacgttacccgtcggtaatacaagactatttaaagcagcggcagttttcacgccgtcttttaagccaataatatcgcgaatagatgcaaggtgttttccgtatgaaccaaataaaccacatactaaagcgtctgcataacctaagctaagcaatgtagaagctaatacggtagtgttagaacgcacgacacgttttgcaatcgcaggtgtaatgcctttacgtttagtaagttcgtaatagtgtttccaacattcttcatagcgaggattatcttcgttatccacaatttcaaaatccacacctgcagttaaacgtaaaccaagttttttaattttttcttcaatcacactgcggcgaccaattaaaattggatttgccaagcccattgaaatcacttcttgggtagcgtgtaatgctttattttcttccccttccgctaaaataatgcgttgttttgccgattttgcttggctgaaaatagggcgcataaacaagttggttttgtaaacaaactgagtgagttggtcaatataaatatcccaattttgaatcggacgagttgccacaccagattccattgcagcttttgctaccgctggagcaatacgcacaatcaagcgaggatcaaatggacgaggaatcacataatccgcaccaaatgttgccccttctccaccgtaagcagaggttaccacttcgttttgctcttctaatgcaagatcagcaatggcataaactgccgcacgtttcatttcttcattaatagtggttgcgcccacatctaatgcaccacggaaaataaatgggaaacaaagcacgttatttacttggtttggataatcagaacgacctgtacatacaatcgcatcaggacgaaccgcttttgcttctggcggggtaatttcaggatttggattagctaaagcaagaataattggatgcgcagccatggttttcaccatatcttgtgtaagcgcaccagccgcagaacaacctaagaaaatatctgcatttggcatcgcatcaccaagtttacgccagccattatcttcaattgcataatcttttttggtttgatccattttgtcatcacgacctttatatactacgcctttcgagtcgcaaaccgtgatattttcacgtttcatacctaaagaaagcaataagttcaagcacgcaattgatgctgcacccgcaccagaagcaacaagtcgaacatcttcaatttttttacctacaatacgaagagaattgatgatcgcggcagcactgatgatcgctgttccatgttggtcatcatggaatacaggaatattcatacgctcacgtaatttttgttcaatataaaaacattctggtgctttaatatcttcaagatttactccaccgaaagttggctctaacgaggcaataatatccacaagtttatcgggatcatgctcattcacttcaatatcaaacacgttgatgcctgcaaattttttgaacaatacgccctttccttccattacaggtttgcccgctagcgcgccaatattgccaagtccaagcaccgctgtaccattggaaatcaccgctactaaattgccacgcgcggtatatttgtaagaggcggcaggatctttttcaatttctaaacaaggctctgccacacccggtgaataagctaaagccagatcgcgttgtgttgcgagtgattttgttggggtaacttcgatttttccaggaattggaaattcgtggaaatctaaggctgcttgacgtaattgttcgctcataataagtgctccattttcttgaaacaggattgaaatactgcgtcgattatatctgttttttattcaaaaaattgtgacgaactgcaaattcttacaactttataacaaaatttttttgatgcgaggcattagctagacttttcatttttcagtaaaaaaggtaggattttcgcaacaaaagcataaaggatgagaaaatgaatccatttcaaaaaattaaaagtgcggtgaataaatgccaaagattttttatcaatcgttcattacaacgtaaattgactaaccaaggcatgactgtcatttctgccaattgcgtgggggcttttatcttacatgatttacaccagccgtttaattccccttttgtgaatctctgtctctcgccacaggattttttgcgttatttacaaaatatggatttctaccgtactcaacctctcacattcgtacaaacagaaaaaagttatcctgtgggaaaacttgctgatcttgaaattcattttatgcattatcacagtgagcaagaagccaatgaaaaatggcaacttcgcacgtcacgaatgaagttagacaatctttttattatgatgacagatcgagacggcgtgaccgaaaaagacattcaactttttgatcaactccctttcaaaaataaagtgatttttactcacaagccctatccagcttttaaatcggcttattatataaaaggcttcgagaagcaaaatcaggtgggcgatatttttgaattttctggctggaatgggaaaaaatattacgatcaattcgattacctgaagtggtttaaccaagcttaatagataaaggctgcattgcagccttttttgtttcgttctaaaagcaaaaacctgtacaatgcctagcgaattttaacaagagaaaacataatgagattagataaatttattgctgaaaatgtgggattaactcgttctcaagcaacaaaagcgatccgccaaagtgcggtaaaaattaatggtgaaattgtcaaaagtggtgcggttcaaatttcacaagaagataaaatctattttgaagatgaattattaacttgggtagaagaaggccagtattttatgttgcataagccacaaggctgtgtttgttctaatgatgacggcgactatccaacaatttatcaattttttgattaccctttagctggaaaattacatagcgcaggtcgcttagatgtggatacgacaggtttcgtattgcttaccgatgatggacaatggtcacatcgcatcacttcgccaaaacatcattgtgaaaaaacctatttggtaacattagctgatcccgtagaagaaaattatgcagcggcttgttcggaaggtattttattacgcagagaaaaagagcccactaaaccagcaaaattagaaattttagatgattacaatgtgaatctgaccatttctgaaggtcgttatcatcaagtaaaacgtatgtttgccgcacttgggaataaagtcgttggattacatcgctggaaaattggtgatgtagtgttggatgaatccttagaagaaggcgaataccgcccattaactcaaagtgaaattgaaaagttagtaaaataatatgaatcaacaaaaatcgactttcatctttattcttaccctcggtattctctctatgctaccgccctttggcgtggatatgtatttgccgtcttttttagaaattgcgaaagatctcggcgtgagtccagaacaagtacaacacacgctcacctcttttgcttatggcatggcgtttggtcagcttttttgggggccttttggtgatagtttcggacgaaaaccgatcattttactcggtgttattgtgggtgcattaacagctttagtgcttaccgaaataaattcagttggaaattttaccgcacttcgttttgtgcaaggtttctttggtgccgcacctgtagtactttctggcgcattattgcgtgatttatttagtaaagatcagctatccaaagtgatgtccaccattacgttagtgtttatgcttgcgcctttagttgcgccaattattgggggttacatcgttaaatttttccattggcatgcgattttttacgttatttcgcttgtgggattattagccgctgcattggtctttttcatcattccagaaacccataaaaaagaaaatcgcattccgctgcgcttaaatattatcgctcgcaatttccttctgctttggaagcaaaaagaagtgcttggctatatgtttgccgcctcttttagctttggcgggttgtttgcttttgtgacggcaggatcaattgtctatatcggcatttatggcgttcccgtcgatcagttcggttatttctttatgatgaatatcgttacgatgatctttgcctcgtttttaaatagccgatttgttactaaagtgggtgcagaaacaatgttacggatagccctcgcaattcaattcctttctggaatgtggctaattttgaccgcacttttagatcttggtttttggccaatggcaattggcgtcgcctttttcgtcggtccaaacccagtgatttcatcaaatgcaatggcatcagctttagaaaaatgtcctcaaatggcgggaacaacaaattctttgattggtagcgtacgttttgcagtgggtgcaattatgggaagtttagtcgcgtcaatgaaaatggatactgccgcaccaatgctctttactatgggggcatgtgtcgtgatttccgtgttggcgtattactttctaaccagccgaaatcttaaaagccgtgggtaaattccccacggcgcaatgattgttttctttattaaacaaaaaccatccataacggcaagcaaacagcaataaataataggataaataaactattggtagataatatccacttttggaaactatgcagaatcagaatagccgcaatcacaaaatggcaaacaaaataaatgatgtaggcaaaaacactgtcagaattaaccgcactttccataccatttaaaagtaaaaataaaaacattgccaaagcatttagagcaagcaatataatcattgctaagggcaacaatgctataaaaccttgtaaacgatttcgtgcaataacaagcgcaagatttgctaaaatcacgccagataaaattggtgcaaaagggttatattcagcaaaatcactcgcaggaagcacggtaaaaatcattaaataactcaagcaacctaaacccgcaattaatgcagccatcaataaaaagctgttacgaattttttcagttttgggttgtttccaaataaaatacacgacagaaagaccacatacgctcattacgttagtaagcgtgtgattattttgtaataggcttatcagcaaccacactgcccaataaatagcaaaagtcatattcactttgattaaacgaccacgttgtcctgggcaaatttcgccgcgataaaacaccaacaacgaaattaactgtgcaaccaacacgcctacacctaaatgaggcattgtttgcttttcagattgcaaagaaaaaataaatagatcgatgccaagcaccattgagatcgataataccgcaagcaatgctgcgatatatttagaagattgttctgacataattttgacgtctgaaaaaataatgcgtcattatgctaaaaattcattaaattttaaagtaaaatgaaaccaattttaaccgcacttaggtacatgaatgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgccggtgtttaattaccaagaactcacatcggaagaacaagataagctgccaaataaaaagaaataaatacaataaagggaataactatgttagaacaaatgggtaaacaagccaaagatgctgcatttatcttggctcaactcaccactgctgaaaaaaattgtgcattatccattattgcagaacaactccaacaacaagcaccgcttatcttagccgaaaacgcaaaaagatattgaacttgctaaacaaaatggattatcggatgccttgattgatcgcttactgctcacacaagaacgtttacaaagcattgctaatgatgtacgccacgttatttctctagcagatcccgtggggaaaatcatagacggcggtacattggatagcggacttaaaattgaacgcgtacgcactccgctcggcgtcattggtacaatttatgaagctcgcccaaatgtgaccattgatgtggcaagtctttgccttaaaactggcaatgcggtgattttacgcggcggtaaagaaacacaattttctaacaagattttaatcgaagttgtacaaaatgctttagagcaagcaggcttaccaaaatttgcggtgcaagccattaccgatccaaaccgtgaactcgttatgcaattattaaaactggatcgctatgtggatatgattattcctcgtggtggttcgggtttacatgaattgtgtaaacaacattcgactattcctgttattgtgggtggtgtgggtgtttgtcatactttcgttgaaaaaagtgcggatcaaaataaagcgatttttgttattgataacgccaaaacccaacgtccaagcacctgtaacacattggaaacattgttagttcaacattctattgctgaagaatttttaccaaaactcgtctctcacctcgctaccaaaaacgtaaaatatcacgcaaaatccaccgcacttaatatattgaaacaagcaggtgcgaatgtctgcgaagtgacagaaaaagaattgcgaaaagaatggggatcattggatttgaatgtggttgttgtggaagatattcatgccgctattgagcatattcgccaatatggtacgcaacattctgaaagtattttaacttcctcacaaaacctagcacgtcaatttatcaatcaagttgatgcggcagccgtttatgtgaatgcaagtacacgctttactgatggcggacaatttggattaggcgcagaagttgccgtgagtacccaaaaacttcatgctcgtggccctatggggttagaagcattaacaagttataaatgggtttgtgaaggcgaatacaccgttcgcaaataaaacccaaagtgcggtaatttttagaagagattatttgcatataaaaaagtccgcgaaatgcggactttttcattatctttatttgtcagatttacccaagttatcaaagaattttttcacaccgtctaaaaatcctgaagattttggtgcgtgtttacttaaatctttaccttgtaaactttcctcaagtttgtggagtaattctttttgttcgctggttaaattaacgggcgtttctaccacgatacggcaaattaaatcgcccgcataaccactacgtgtagaagcaacaccttttcctcgcatgcggaataattttcctgtttgcgtttcagcagggattttaagtttcactctgccatctaaggtcggcacttcaatttcaccgccaagggctgcagtagcaaagctaatcggtacttcacagtaaagattagagccatcacgttcaaaaatattatgttctctcacgtgaatcacaacatataaatctccagctggtgcgccattttcgcctgctgcacctttaccagctaagcgaagttggttgcccgtatctacgcctgcaggaatttttactgaaagattttctttcttatgaactcgtccttctccatgacaactgcgacaaggtttttcaattttcttaccgctaccgtgacaagttggacaaatactttcagatacgaagaaaccttgctgacgacgaattcgaccagaaccgtggcaatgcggacaagtttccactttagaacctttttcagccccagagccaccacagctatcacaatgtgcaagagtattgatttgaatatctttggttgtaccttttacggcttcttctaggctaatttctaagtcataacgtaagtcttcgccacgaacaacgcgctgacgaccacgtccaccaccgaaaatatcgccaaaaatatcaccgaacatatcaccaaaatcagcaccgccaaagccgccaccgaagccaccagtgccaccaccttgttcaaaggctgcgtggccatattgatcgtaggctgcgcgtttttgatcgtcgcctaatacttcataagcttcattaatttctttgaatttttcttctgcttctttactgccttggtttttatcgggatgatgtttagacgctaaacgtttatacgcacgtttgatgtcgtcctcactcgcccctttttgtaggccaaggacttcgtagtaatctttttttgccatagtaattttgtaatttgttgctgaaaataaatacaccaaaagggcgtgtttccacgccctttgtttatgctaagaagagcggtgaattatttattatctttcacttcttcaaattcagcatctaccacgccatcatcttttgctgatgattgttgtggttgctcgccaccagcttgttgagcttttgcttgcactgcttgcattaatggttcagaggctttaattaccgcttcaatttttgcttcaatttctgctttatcttcgccttttgctgctgtttcaagctcagcgactgcagcttcaattttctctttgtctgcgacactcaatgcatcgccagcttctgcaatttgtttacgtgttgcgtgagcaataccatctgcttggttacgagcttgaacaacttcttcaaatttacggtctgcatcagcatttgcttctgcatcacgcaccatttgttgaatttcttcatcagataaaccagatgatgcttgaatacgaatttgttgctctttacccgtatttttatcttttgctgatacgttgattacgccgtttgcatcgatatcaaatgttacttcaatttgtggcataccacgcggtgcaggattaataccttctagattgaattgacctaaagatttattgtctgccgcacgtttacgttcaccttgaagaacgtgaatagttaccgcactttggttatcttctgctgttgagaatacttgcgattttttagttggaatagtggtatttttctcaattaaagtggtcatcacaccgcccatggtttcgatacctaaagataatggagttacgtctaataaaagaacatctttcacatcaccttttaatacaccaccttgaactgccgcaccgattgccaccgcttcatcagggtttacatctttacgcgcttctttaccaaagaactcagcaactttttgttgtacaagtggcatacgagtttggccacccacaagaataatatcgtggatttcgcttacacctttatctgcatcttttaataccgctttcaaagactcaattgagcttgccactaaatcttctactaatgcttctaattttgcacgagtgatatttaatgctaagtgtttaggacctgtcgcatctgcagtgatgtacggaaggttcacttcagtagattgagctgatgaaagttcaatttttgctttctctgcagcttctttcacacgttgtaatgccattgcatcattacgtaaatcgatattttgttcttttttgaactcatcaataatgtaatcaattacacggttatcaaagtcttcaccacctaagtgagtgttaccaccggttgccaatacttcgaaagtttgttcgccatcaaagttatcaatttcgatgattgaaatatcaaatgtaccaccacctaagtcataaacagcgatcacttggttctctttgcttgaacctaaaccaaacgctaacgcagccgctgttggttcattaatgatacgtttaacatctaaacctgcgattttacctgcatcaatcgttgcttgacgttgtgcgtcgttgaagtatgcaggcacagtaattactgcttcagttacagattcacccaagaaatcttctgcagtttttttcatttttttcaacacttctgctgaaatttgcggtggggctaatttatcacctttcacgtttacccaagcatcgccattgtcggcacgagtaatttcgaaaggcataattttaatatcgcgttgaacttcttcactttcaaaacgacgaccaattaaacgtttaatcgcaaacaatgtattttttgggttagtgattgcttgacgttttgctggctgaccaactaaggtttcattatctgtatatgcaatgattgacggagtagtacgtgccccttctgcattttcaattacgcgcgctttatcgccgtccattacagctacacaagagtttgttgtacctaagtcaataccaataatttttcccattttgtactcctagtaaaaattttaaaattcggggtagggcttttagacctatttattacgaattgtaagatgtggatattctttcgcatttcaagagaaaattttaaaaattttttatttcttaaagtgcggtaatttccgttcttgtttttcaaaataagtctcaaatgatgaagttcaaagggaaaacaaaaattttcaggcaagaaaaagggatttgtgataaatttggcgaaaatttttactttaaaataggaaagaaataaatgaaaaaatcaaaaattgctgcaggcgtagtcatttctcttgctgccgtttggtgtgcaggtgcatggtttacagggaaaaaagctgaagaagaatatttacatcaactaaaacagttaaatcaactatttaccaaaactgaggcattagaagaaagtaaaattttttataaaaatataaaatttgaaagaggattatttgcctctcacattcaagatcaaatagaaattcacaaggcaaatgaaacgatcattattcctttatcatcaacactttatcacgggcctttgccgcttgatcgtgtggcaaaactgaatttcgttccagccattttttcaagccaaacattgttaggaaaaaatgcaacaactcaggcattctttgatatcacagaatcagagaaaccgttacaactgaatttcgcaatgaattattcattaagcggtaatgcggaattaaaacttgcatcggggcaatatcacaatgagcaatctaagacagattttgattggtcaaatgtcgtattaaatattgatttaaaccaaaatacaccaaataactatgtgctatctgtcgatacatttaattcaaatgcccctaatcatgcagtttcaaccgcttcatcaattaaaataaaagatcttgtcgtacaaggctcgttgcaaagcacaaaatggccatttatttatagtgggaatatcaatagtaaaataggctattttgagcaaaataccgaatctccagagactggcgaaaaattctctcttattcagaaaaatagccaagcaaatttaactacacaagttgagggtgatacagtaaatatcatcaataaaacgaatctggatgaattacatattaacggtaacaacttaggtaaagtgaccaacaatgtagaattcaaccatattgatggcaacgcattacaagaacttttaaatattttagttgcaataggcaaagccgactcagatatgcctttatctaaaacattggtgcaaaaattacaacaagcaggcatgatcattgcgaataatcagcctcaaattaaatttacccctctttctatttctgatgaaaaaggcaaagtggcattggatctaaatattgctttagtgccaaatcctaaatttgatttaatgcgcagtggcttatacaaacaattcaaagatttttcaatcaattttgatgtgaacaaagaaactgcgatttcattgttatctaaatttgtaccagaaaaccaaaagcaagatttcgttcaccgattgaatgaattagttaccgaaggtgaagtgaatgacattatcgtaaacacggacaaaaccgtaacattaacgcttgctctagaaaataacgacttgaaactaaacggcaagccaatcccagaagaacagttgaaagtggtactctttatacttgtaatggggggatttgggagataactgaaacagggcgataaattgtcgccctgttttgtatttaattaaaagtatcgtagggtgggcttcagcccaccgtttttattctattttttatggttaattggtgggctaaagcccaccctacaactataaagtgcggtaaattttcgttgcagtttaagctaaccgctcttttaaatacccttcataatctggtacgtcaatttccacatcttgttcaaataaaactgaagttaaaagaaaatctgcagagctttgattaatcgcaacagggatattccacactgttgcaatacgcataagggctttcacatcaggatcatgtggtgcagcattcattggatcccaaaagaagatcatcatgtcgattttcttttctgcgattaatccaccaagttgttggtcacctcccatcggaccacttaataaagattgaatgcttaaacctgtttctcgttctaaaatatgccctgttgtacctgttgcataaagtatatgaggcttaagtgcctctttgtgtttttgcgtccaattcagtaaattttttttacaactatcgtgagccacaagtgcaatacgtttgtgttgagtgagggttcgagttgttgtctgcattgctgagtcctttttgaaaaaaatctgaaaaaactttaaaacaaagcccgatggaatgcaatattttactggttattttagcgaacaaaaaaacacaaaaaaattaccgcactttcaaataattatttatggcaaagctgatttgatatgatgatttgatgaaaattcactatctttatctcaaaaaatcttctaaaatttacaagatttgttaaatgtttgtgaaaagcaaatattgccgtattcgtgtttagccttgtctaaactaatattcactcaaaacagattaaggaaaacctatgtctgagattttaaaaaatgacattgatccaatcgaaacacaagattggttgcaatcattagattcattaattcgtgaagagggcgttgagcgtgctcaatatattgttgagcaagttattggtcaagcacgtacaagtggtgtttcattgccaacaggagttaccactgattacgtgaatactattcctgtggctgagcaacctgcttatccaggtgatcacgccatcgaacgtcgtattcgttcagcagtacgttggaatgcgatcgcgatggttttacgcagtcagaagaaagatcttgatttaggtgggcatatttccactttccaatctgcagcaacaatgtatgaagtttgctacaaccacttttttaaagctgcaacagagaaaaatggcggcgatttaattttcttccaaggccatgcagcaccaggtatgtatgcgcgtgctttcttagaaggtcgtttaactgaagaacaaatggataacttccgtcaagaagcctttaccgacggtttatcttcatatccacaccctaaattaatgcctgaattctggcaattctctacggtttctatgggtttaggccctgtgaatgccatctaccaagcgcgtttcttaaaatatctcgataaccgtggtttaaaagataccaaagatcaaaaagtttatgcattcttaggcgatggcgagatggatgaaattgagtctaaaggtgcattaacttttgcggctcgtgagaagttagataacttaatcttcactatcagctgtaacttacaacgtttagatggccctgtgaatggtaatggtaaaatcgttcaagaattagaagggctatttactggtgctggctgggaagtgattaaagttttatggggcagcgattgggataaattattcgcgaaagatacttcaggtaaattaactcagttaatgatggaagtcgttgatggagactatttaacctttaaatctaaagatggtgcatatattcgcgaacacttcttcggtcgttatccagaaactgctgcattagttgctgatatgaccgatgatgaaatctgggcattacgccgtggtgcacatgatagcgaaaaattatatgcagcctatgcaaaagcacaaaatgcaacgaaaccagttgtgattttagcgcatcaagttaaaggttataaaattcctgaagcggaaagtaaaaataccgctcaccaatctaaaaaaatgtcttacgaaagccttaaaggtttccgtgacttctttgaattaccattaaccgatgaacaagtagaaaaattagaatacattaaatttgctgaaggcacacctgagtatgaatacttacatggtcaccgtaaagcattaaacggttatgttcccgctcgtcgtactaaatttgatgttgaatataaagttcctgcattagaagagtttaaagcattattagaagaacaacctcgtggtatttcaaccactatggcgtttactcgtgcattaaacatcttattaaaagataaaaacatcggtaaaactatcgttccaatgattgcggatgaagcacgtactttcggtatggaaggtttattccgtcaagttggtatttataacccacatggtcaaaactatgtaccttcagaccgtgatttagtggcttactatcgtgaagcaaaagatggtcaagtattacaagaaggtatcaatgaattaggtgcaaccgcatcttggttagcagcagcgaactcgtactctgtcaataaccaaccgatgattccattctttatctattactcaatgttcggtttccaacgtgtgggcgatatgatgtgggctgcaggcgaccaattagctcgtggctttatggtagggggtacttctggtcgtacaaccttaaatggcgaaggtttacaacacgaagacggtcacagccatattcaagcgggcgttattcctaattgcgttacttacgatccatcatttgcatttgaagttgctgttattatgcaagacggtatcaaccgtatgtacggcgaaaaacaagaagatgtattctattatatgactacattaaatgaagtgatggatcaacctgcaatgcctgctggtgcggaagaaggtatccgtaaaggtttatataaatttgaaacagtggaaggtaaaaaaggcaaaggtcacgttcaattattaggttctggtgcgattatgcgtcacgttcgtgaagcggcacaaattcttgcaaatgactacggtgtgacttcagatgtattttctgcgccttcattcaatgaattagcacgcgaaggtcatgatgcagcacgttggaacttattacacccaacagagacacaacgcgtaccatacgttgctcaagtattagctgatttaccaaccgttgcttcaactgactatgtgaaaggttatgctgatcaaatccgtgcatttgtaccaagtaagcactatcatgtattaggtacagacggtttcggtcgttcagatagccgtgcaaacttacgtgaacacttcgaagttgatgcacgttatgttgtggttgctgcactttctcaattagcgaaagaaggtacagtatctaaccaagtggttgcagatgcgattgcgaaattcggtttgaatgtagatcgtatcaatccgctttatgcgtaattgatgaaaactgcggtcaaaaaacattgtgttttatgaccgcactttaaaaggaacaaaaaatgtcaaaacaaattcaaattcctgatattggtagtgatgaagttaccgtaacagaagtgatggtaaacgtaggcgataccatttctgttgatcaatctatcattaacgttgaaggcgataaagcttcaatggaagtgcctgcaccagaagcgggtgttgtaaaagaaattttagtgaaagtgggcgataaagtttcaactggtactccaatgcttgtattagaagcggcaggtgctgctccagcagctgatgagcctactgctccagtagctgatgcgcctactgcaccagtggttgctaccgcaccaacggcttcagctattgtagaagtaaatgtgccagatattggtggcgatgaagtcaatgtaaccgaaattatggttgcagttggcgatacaatcactgaagaacaatctttaattagcgttgaaggcgataaagcctcaatggaagttcctgcaccattcggcggtgtggtaaaagaaattttagtgaaatcaggcgataaagtttcaactggttcattaattatgcgttttgaagtactaggtgcagctccagcagcatcagcatcagcttcaacatcagcaccacagacagcagctcctgctactactgcacaagcaccacaggcagcagctcctgctactactgcacaagcaccacaggcagcagctcctgatactactgcacaagcagctcaatcaaataacaacgtatctggattaagccaagaacaagtagaagcaagtacaggatatgcacacgcaacaccagttattcgtcgtttagctcgtgaatttggtgtaaatctagataaagtaaaaggtactggtcgtaaaggtcgtatcgttaaagaagatattgaagcttatgtgaagaccgcagttaaagcttatgaaagcggtgcaacagcacaagctactggcaatggtgtagcaaatggtgctggattaggcttattgccatggccaaaagttgatttcagtaaatttggcgaaattgaagaagttgaattaagtcgtatcaacaaaatttcaggtgctaacttacatcgtaactgggtaataattccacacgttactcacttcgataaagcagatatcacggatttagaagcattccgtaaagaacaaaatgcgttagcagaaaaacaaaaactcggcgtaaaaatcacgccagttgtgttcattatgaaagcggtggcaaaagcattagaagcgtatccacgtttcaatagctcaattaccgaagatgctcaacgcttaatcctgaaaaaatatattaacatcggtgtcgcagtagatacgccgaatggcttagtcgtgcctgtattcaaaaatgtgaacaagaaaggcattatcgaactttcacgtgaattaatggaagtatcgaaaaaagcacgtgaaggcaaattgactgcatctgatatgcaaggtggctgtttcaccatttcaagtcttggtggtattggtacaacgcactttgcgccaatcgtaaatgcgccagaagtagctatccttggtgtgtctaaatcatcaatggagccagtatggaacggtaaagaatttgcgccacgcttaattcttccaatgtcattatcattcgaccaccgtgtcattgatggtgcagatggagctcgtttcattagctatcttggctctgttttagcagatttacgtcgcttagtaatgtaatctgtaggtgggctttaagcccaccgattaatgaaatctttggtgggcagaaacccatcctataaagaccgtaaaagtgcggtcaatatttttaacgtttttacgaggtaaaaatgagtaaagaaattaaaacccaagtcgttgtacttggtgcaggtcctgccggttattcagccgcattccgttgtgcggatttaggattagaaactgttattgttgagcgttattcaaccttaggtggggtgtgtttaaacgtaggttgtattccatctaaagcgttattacacgttgcaaaagtaattgaagaagcaaagcacgctaataaaaatggtatttattttagtgaaccacgcattgagctagatgaagtacgtgcaggtaaagaagctgttgttgctaaattaactggcggtttagcaggaatggcaaaagcacgtaaagtgactgttgttgaaggtttagcgacttttaccgattctcacacattagttgcgcgtgatcgcgatggaaacccaacgactgttaaattcgacaatgccattattgcggcaggttctcgtccagttcaattaccctttatcccacacgaagatcctcgtatttgggattcaacagatgcacttaaattaaaagaagtaccgaaaaaactacttattatgggcggtggtatcatcggtttagaaatgggtactgtatacaatgctttaggttctgaagttgaagttgttgaaatgttcgaccaagtgattcccgcagcagataaagatgttgttggtatttacactaaacaagttgagaaaaaattcaagttaatgcttgaaaccaaagtgactgcagttgaagcaaaagatgatggtatctacgtttcaatggaaggcaaagcctgtaatgacaccaaacgttatgatgcagtacttgtcgctatcggtcgtgtgccaaatggtaaattgattgatgcaggtaaagcaggcgttgaagtagatgatcgtggttttattcacgttgataaacaaatgcgtaccaacgtgccacatatctacgcaattggggatattgtaggtcagccaatgttagcacataaaggtgttcacgaaggtcacgttgccgcagaagtcattgcaggacaaaaacactacttcgatcctaaagtaattccatcaatcgcttataccgaaccagaagtggcgtgggtaggtaaaactgagaaagaatgtaaacaagaaggcttaaactacgaagtggctaaattcccttgggctgcatcaggccgcgcgattgcatctgaatgttcagaaggtatgacgaagttaatctttgataaagatacgcatcgtatactgggcggtgcaatcgtaggttctaatggtggggaattattaggcgaaattggtttggcaattgaaatgggttgtgatgcagaagatatcgcattaactatccacgcacacccaacgttacatgagtctgttggcttagctgcggaagtatttgaaggctcaattactgaccttccaaatgcaaaagcgaagaaaaaataattcttattgaagaatttttaattctgcttagattaaaaattccagcctaaataaaaatccccaattggggatttttattttcctctctttctatttttttatgatagaatgccaatctaaaaacgtttcttttttttaccgcacttttgagcattatttatgactacacaacttgatttaatcaaatcttctatcaaatcaattcctaattatccaaaagaaggcattatcttccgcgacattacgacccttttagaagttccagcagcttttaaagcaacaatagatcttattgtggaacaatatcgcgataaaggaattaccaaagtgcttggaactgaatctcgtggttttatttttggtgcccccgttgccttagcactaggtttacctttcgaattagtacgtaaacctaaaaaattaccacgtgagactatttctcaatcttatcaattagaatatggtcaagatactttggaaatgcacgttgatgcaatttcagaaggtgacaatgttttaattattgatgatttattagcaactggtggcacagttgaagcgacagtaaaattagtgcaacgtttaggtggagcggtaaaacacgctgcatttgtgattaatttacctgaattaggtggcgaaaaacgcttaaataatttgggcgttgattgctatacactcgtcaattttgaaggtcattaattaaggattcgatgagctatcaagtcttagccagaaagtggcgaccaaaaacatttgctgatgtcgttgggcaagaacatattatcacggcattagcaaatggattaaaagataatcgactacatcacgcttacctcttttcaggcacgcgtggtgtaggaaaaacctctattgctagattattcgcgaaaggattaaattgtgttcacggtgtaacggcaacgccttgtggcgaatgtgaaaattgtaaaactattgagcaaggcaattttattgatttaattgaaattgatgcggcgtctcgcacaaaagttgaagacacgcgtgaattattggataacgtgcaatataaaccagttgtgggcagatttaaggtttacttaatcgatgaagtccatatgctatctcgtcattcatttaatgcgttgctcaaaactttagaagaaccgcccgaatatgtaaaatttttactcgcaacaacagatccacaaaaactacctgtaactattctttctcgctgtttacaatttcatcttaaagcattagatgaaactcaaatctcccagcatcttgcccatattttgacgcaagaaaatattccttttgaagagcctgcattagttaaacttgcaaaagcggcgcaaggaagtattcgtgatagtttaagtttaacggatcaagccattgcaatgggcgaccgacaagttacgaataatgttgtaagcaatatgttagggttgcttgatgataactattctgttgatattttatacgccttacaccaaggcaatggcgaactcttaatgcgaacactgcaaagagttgcagatgcggcaggcgattgggacaaattacttggcgaatgtgcagaaaaattacatcaaattgcactcatgcaacttcttccacaaaaatcttcagatgacaatgaacatttttcatttttagccaaacatatctctccagaagatgttcagtttttttatcaagtgattgtttctggtagaaaagatttatcaaatgcgccaaatcgtcgtattggagcagaaatgacattattgagggcattggcattccacccaaagttccttacggcagtaccaaagactaacactacaattactccaccgccatcaacgccaagtgcggttgaaaatactggtaattatgtagatgtgccagtactgtcgcaaagtataaaatcagcttattctcaagcaaaaccaaataaaacgagcattccaaatttggcaagcctttccgctttagatgcgctggaacatttaacacaactcgaaaaccaagaacgtcaagaacacaaagctgaatcattagctgtagtaagtgaaactttacatcacatccaagaactggatgaagaaaaatctcataaaaaaatgaccgcacttcccgtgcgagaaatgactgaaccaaagcccaagcacatagaaaaaccaacatcaccaccaaatgccgcacaagctccacaagaaaatagcacagaagaaaattcaagtgatgataatgcagaagttgctcaagatgaacaagaaatcttgagtgctgacacctatcgttgggaatggagcaatccagaacttgctaaagccgatacaggcgttcgtccttctgatataaaacaggcgattttaaaagatattacgcctgaattacgtttaaaaatcatcacccaaactcaacaacaagatgagtgggcagatatagttgaacgttctggcgtaacaggatttagcaaagaattagcgttaaattgtttcttacaaagcaaaaccgatgatgaaatcaatcttggactacattcagaaaaatctcatttacgccaagacagaagtataaaaaatttggttgaagctttaagtaaattgcaaggtaaagatattcgattaacaatcaatcttgatgatagcaatgtcgcgacgccaattgaatatcgccgtaatatttatcaagcattgcgggaaaaagctcaaaatgaattgcaaaaagatagcaaactacaaatgttgcttaatgaattcgatgcaaaattagatgtagagagtattcgaccagtttaaaaatattgtgttttcccctcaagatttccctgccaaatttataaaaccatcagaatatttttattaagctctaccattttgtatgtttttaatctaaaattcgtcaatttgttttttaagagccaaaaggagagtgaaaatgaaactagttgaagtaaaacacccacttgtaaaacacaaactaggtgtgatgcgtgaagctgagattgatacaaaaaaattccgtgaactggcaacagaaattggtagcctattaacctatgaagcaacctctgatttagaaactgaaaaagtaacgatcaacagttggaatggccctgtagaaattgatcgaattaaaggtaaaaaagtaacggttgtgccaattttacgtgctggtttaggtatgatggatggtgtacttgaacatgtaccaagcgcgcgtatcagtgtagtgggaatctaccgtaatgaagaaacccttaagccagtcccttattttcaaaaattagctagcgatttagaagaacgtcttgcaattgttgtcgatccaatgcttgcaacaggcggttctatgattgccaccctcgatcttttaaaagcaaaaggttgtaaacatatcaaagtattagtgttagtggctgcaccagaaggaattaaggctcttgaggctgcgcaccctgacattgaactctactgcgcttctattgatagccatttaaatgaacaaggttacattattccgggtcttggtgacgcgggcgataaaatttttgggacaaaataatccccaaaacaagacggcatttaagccgtcttttttccgtgcgtgaaacacaagaaaaactgaccgcacttttaagttaattcaaacagagagttgaaactaaatgacaaaccaaacttcttcttttccttcggaaaatcaaagcaaattaaaacaatctttcgttggcctacaaatgctcttcgtcgcatttggtgcgcttgttcttgtaccattaattacaggacttgattccaatacggcattattaacagcaggcgttggcactctacttttccaattttgtacaggcaaacaagtgcctattttcttggcatcatcttttgcctttatcgcgcccattcaatatggtgttcaaacttggggtattgcgactacgatgggcggtttagcgtttactgggcttgtttatttcgccttgagtacgttagtaaaattacggggagcagaagcactacaacgttttttcccaccagtggttgttgggccagtaattattatcattggcatggggcttgcacctattgcggtggatatgtcattaggtaaaaacagtaactatgcttataacgacgcagtattagtttcaatggtaacgcttcttaccactttatctgtggctgtatttgccaaaggattgatgaaacttattccaataatgttcggtattaccgtaggctatattttgtgtttgtttctgggtttaattaatttccaaccagttattgatgcaccttggttcagtttgcccaaattaacgacacctgaatttaacctagaagctattctttatatgttaccaattgctattgcccctgccgtagaacacgttggtggtattatggcgattagctctgtgacaggtaaagattttctaaaaaaaccaggattacaccgcactttattaggcgatggcgtcgctactgctgcagcttctttagtgggcggtccgcctaatacgacttatgcggaagttactggtgctgtgatgctaacacgcaactttaacccaaatattatgacttgggctgctgtttgggctattgcgatttcattctgtggaaaagtaggcgcattcctatcaaccattccaacgattgtaatgggtggaattatgatgcttgttttcggttcaatcgcagtcgtgggcattagcaccttaattcgtggcaaagttgatgttaccgaagcgcgtaatctatgtattatttctgttgtaatgacatttggtatcggcaatatgtttgtagatgtgggtaacgtatcactaaaaggtatcagcttatgtgcgattgttgctatcatcttaaaccttgttttaccgaaagcaaaaaatgaagtagaataatcctcatttcaaagggttaaattatcatttagccctttcttacttaatctgtactacataaacatttgaataaacagcttcccttacccattcatcaaattaatgatgccacattagaaaacttttacggcgataataatcttttattgcttgattctttacgcaaaaattcatctgatttaaaacaaccgtttttctacatttggggagataaaggctctggtaaaacccatttacttagagcattcagtaacgaatatttaatcaatcaacgtactgctatttatgtaccccttagcaaatctcaatatttttctaccgcagttcttgaaaatttagaacagcaagaattggtatgcttagatgatttacaaagcgtcataggaaatgatgaatgggaattagctatttttgatctattcaatcgaattaaagcaagcggaaaaacgctgttactaattagtgcagataaatcgccttccgcactttctgtaaaattacctgatttaaactctcgcttgacttggggcgaaatttatcaattaaattcattaacagatgaacaaaaagtcgaagtactacagcatacagcttaccaacgaggattccaattatctgacgaaactgcaaattttttaattacacgactagcacgagatatgcatactttatttgaagcacttgatctactagataaagcatcattgcaagcacaacgaaatctcacaattcctttcgtcaaagaaattttaaatctataacaaaaaaggcactaatgtgcctttttaatcatccacctgataatttaactttaaaccctttttgctctaataattgcttgagcaaatctcgtttttccccttgaattcaataataccatttttaactgatccgccacatccacaacgtttctttaattctgcagctaattttttcaaatcctcgtcagataaatctaaaccagttataaccgatacgccagcacctttcctaccacttgtttgtttttggatacgtacaacaccgtctccttttgggcgaactacagaagccttttcctctttaattcgccccacatctgtagaatacactaaaacaaaatctgacatttatgattacccaatagatacattaatagaacggagaacctccgcaggattatccgcttgagttatagggcgtccaataactaaataatctgaacctgcacgaattgctgcagtaggcgtcatcacacgtcgttgatcaccaaaatcagttcctattggacgaatccccggtgtaactaatttaaactctttaccacaagtattacgtaaaatttcaacttcttgaggggaacagactacaccatctaaacccgcccgttgggttaaatgagctaagcgtaaaacttgttccattggcgatgcattaatcccaatttgtaataaatccaaatcttccatactggttaataccgtcacggcaataagcaatggtgcatctttcccataaggttcaagaattttcttcgcctcttccatcatacgcaaaccaccacttgcgtgtaaatccaccatccatacgcctaaatcagcagcagaacgaactgctcttgctaccgtatttggaatatcgtgatatttaagatccaaaaaaacatcaaagttacgttgatgtaattgttttacaaaattaataccaagtgtagtaaacatttctttacccacttttaatcgacacaaacttggatcaatttgatcaactaaagcaagagcctctgcttctttctcataatccaatgccacaataattttgcttgtcataatgttacctcactgagtatcaattaattatgttcttgatttgaaaccggtttaatactttcccattgacggcaagatgggcaattccacaatagcttatgaatttgataaccacaatttgtacaacgataaggcgatgtttgcttaatcctttcgccaaccattttatgtaataaaattaagctttcttttccccgcccgtcttctgcatcatcaatttgatactgcataaaacgatggaaaattaaagtacttggattttttgtaagttgttgataaagcttagcttgcgcagcagacttaccatctttttcttcaattaatttgactagagctagttctacttcatcattattaataatttgacctgcacgaattaaaaataactcaaaattatctaactgatttaattcttcataacaatgttttaaaggtgacaaaatttcacccgtataatctggattttgctccaaaacattttctaaaatttctactgcttgttgatattgaccatcaagcattgctaaatttgcaagcaataaagaagcgcgaacacaagtcggagaaaccgacaaagccttttgtaaaacactgcgtttttcaaccgcactttcaggttctaaactttgtgaatattcacaataacattgcgcaagttcaatattattctcttgtggctttattttagcgagtttttcagcaatattgactgcttttttccattcttttgttttttgataaatcactaaaagttgctgtaaagcattttctgcaaattcaggttcatctactagtaaaatataaagattctcagctcggtcaaaaaaaccaaccaccataaaatctcgagcaagctgttgttttgcaagtaatttttgttcaaaagtataattaggactaagatctaaagcttgatgaatacgcaatgcacgatcaacttcgcctcgagaacgaaacagattaccaagtgtaagctcggcttcaaattgggagtggctttcgatttcattttcgatttcttgcttttgcaacatatctaaaaacaaatctacagctttatcagtttgattagaaagtaaaaaattcactcccgtaacataatctcgggagagtttattacttatgtcatcttgatctttcttcgcactacgccgccccatataccagccataggcagcagcaataggcaataatagaaagagtaattctatcattaagcgaccttatcgcgcgtagtcgtcaattcattgatttgtaaagtctgacgtttcacttgacgagctagtgccatattttttaattttaacttaatatagaaaaaagcagtaattaaccaaccaagaattaaacctaacccaaataaaattgcaacgaggcttgaaagctgaaactgactttctgccacaatataattaaatgtaataatctgatcgttattcgcaccaatggtaattgcaactaacacaatcgcaataaagatcacaatgcctaaaatatatttaatcatttcatttcctttaaaatatttgtaacccaaaataaactttttaatcaaaaatattttaattaaattttaatcaattaagcctgaacatccactctagcttttaattctttacccgctttaaaatatggaacagacttagctgataagtttactgaatcgcctgttttcggatttcttcccaaacgtggttgccgatgatgtaaagaaaagctaccaaaacctcgaacttcaacacgatcaccattttcaagagattgagaaataaactctaaaatatcttttaccatattttcaatttcttttgcagataaagttggctgttttgctgacaatttttccataagttctgacttagtcatcctctatacttccttaatattatttaaattaagatctattgataataaattacacaaatatattagcaataactcctaacaaataaggctggacatcagcccagccttattacgtgaattaattattcacctttagctgctttaaatgcttcagccattgcatttggaataacaatatcttcttgtttgtatttacacttgcaactgcgcagcttcttcagcttgatcttttgctttcactgataagtgaacaatgcgagatttacgatctactccagggtatttcgcttcaaccacatcgccaatagctacttcacttgttaaatcagcagaacggatataaccttcaacaccacctgctaattcaactttagcacctttagcatctgcttcaacaacagttgcagatactaccgcaccttttttgttgattgcaacaaagttattgaatggatcttcttcaagttgtttaatacctaaagagatacgttcttttactgcatcaacagctaatacaacagctgacacttcgtcaccttttttgtattgacgaacagcttcttcgcctgaaatactccaagaaatatcagataagtgaactaaaccatcgataccaccttcaagaccgatgaagataccgaaatcagtgatagacttgattttacccgttactttatcgcctttgttgtgagtatcagcaaattgagtccaagggttagctttacattgttttaagcctaaagaaatacgacgacgttcttcatcaatttctaataccattacttctacagtatcgcctaagctaaccactttagatgggtggatatttttattagtccaatccatttcagaaacgtgaactaaaccttcaacgccatctaagatttcaacgaaacagccatagtcagttaagttagttactttacctgttaatttgctgtttactggatgattttcagcaattgcagcccaaggatcttgacctaattgttttaagcctaaagatacgcgagtacgatctttatcgaattttaatactttaacagttacttcatcgccaacatttacgatttcacttgggtgtttaacacgtttccaagccatatctgtgatgtgtaataaaccatcaacaccaccaagatcaacgaatgcaccgtactcagttaagtttttaacgatacctttaacttctgaaccttcaacaagattttctaatacttgttcacgttcttggctgttttcagattcaattactgcacgacgagaaacaacaacgttgttacgtttttgatctaatttgattactttgaattctaattctttaccaagtaagtgatctgcttcacgcgctggacgagtatcaactaaagaacctggtaagaatgcacgaacaccgtttaactcaactgtgaagccacctttcactttgccgttgattaaaccgataacggtcgctttttcttcgtaagctttttctaattcaatccaagattcgtgacgaacagctttctcacgagaaagtttagtttcgccgaaaccatcttcaactgcatctaaagcaacatttacagtatcgccaacttggatttcaagttcgccttgtgcatttaaaaattcagcaactggaattgcagactcagattttaaacctgcatcaacaagcacaaagcctttttggatagctactacagtaccgctaacgattgaaccttgacgagtttcaaggccttttaatgattcttcaaaaagttgagcaaaagattctgacatataaataatcttcttaatttaagttaataacatccacattaaaatccataaaatgcggggttgaggataaatgcttattcttccttgaacaaacagttaaatctaaactgataccttttcttgaatataagacaacgcctgatcgatcacttcattgatactcaaggctgtgctatccaataataaagcatcatccgctggttttagcggcgcaacttcacgatttctatcacgaagatcacgctcttttatctcggctaaaatctgtgcaaagttaccatttattcctttattttgcaactgtttatagcgtctttttgcacgttcttcagcacttgcatctaaaaataattttacttgtgcatttgggaatacaactgttcccatatctctaccatccgcaattaatccatcatttttcgcaaaatcttgctgaagttgtaataaagctgaccgcactttttgaaaaactgctacttttgacgcagcatctgccacttcttgcgtgcgaattaaacggctcacatccattcctgcaagcaaaatgtttacctcgccattttgaggaataaattgaatatctaaatgacgtgctaattctgctaaatctgtttcatttgttagatcagttttacgttgcaacgctgccaatgcagtaacgcgataaatcgccccactatccaacagtgcatagcccaacttttcagccaacgcgtaacaaagcgtccctttcccagcaccactaggcccatcaacagtaataatcattcccatacaaattatcctttcattatcaaaattttgcgcattatagagacaatttcccctcattaccatcctagagattattactagcttccatgttttgtatggcttatctaataaagttaatttcacaagctctaggaaagcgtaaactccctttcaagctttttcttaaatttcagaaaatctaaccacatagaaaaaggtttttaaaaacatttcaaggtttttttaataactattgtggcacttaaggacgaaattctttcagctaaagtagctcttttttctattattaaattggacaatccttctgacgttctacacttcgtttatacaaaaaactgaaattaagcacactagacattatgccttttaatatatacgcattttttcaaacttgttctaaagacttttctacattacaataaaaaacgtagctatcaatacaaataaccaaataatgaggacaaagaaatggctgaaaatcgttatgaactaaataaaaacttagcacagatgctcaaaggtggtgttatcatggatgttcaaaaccctgaacaagctcgcattgcagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaataaatgaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtccaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataagtactttatcgatatatgtaaagtagcataaaccattatctgcatatctgccctccctaggaaacaaaccatattgtagcaatgagagcagataattttcatcaaaaaaccgaacagttactagacttaaaaccgaatgcaaggtaggataaggttgaacaaaaacaaaatttcttgttgtattgacgagagcaaacgccacttcgtaattgggctttccccaaaacgaaccaaaatcaacaatcctaaagacattacacaccattgagtatttacaaggtttcaatgcggactgaatcatctatgaaagcaccgacggcttggatcttacgattgccaaaatattatatcaagcagcctttttcgtgctcattgccaatccacgacaaatcaatcactttacaatgtcacatttagtaaccaacaattactgtacaagtgtagactggaataagtcaaataattttgcggtaaacatcagataatttgctgaccttattttgatgagttggctctatctaagaagaggaaataataaacaagcggtcacatttgacatcttgtttgcattttagaggtttattccgcccagtattttttcctcgtcgttttaccaatacctggattaaagctattggttggatccaactctttatagaattttctcaaggttggtttagcctcgtataaatgccctacattgtgttcggctgggtattgcgcaccacgcttgtcaagtaatttcaacatttcgtattctagttcttcataatcataacctttttttacaatgtaatcttggtgaaagacatggcacataaaatgtccgtagtaaagtttagagataattctgttatcaatttctggcggtaacacttcaaaccaatcttgatcattgcgacgtaatgcaacatctaaagcaactatttcttctacttctttttcgtgaattgcacgataacgaattgcagcacttgcaacagcgaaacgatgaagcattgctgcttgggtttcgattgcattacattcaaaatagccaccttttgagccatctgcaatgtaggattccaaatattcacgggcttcttgaatgccttttccacccattttgataattaagtgatgctcgtatttgttgcgataatcccataagctttgtggaagatgttctgggatgaatttagacacagtttgcataagtttatcgcttaaatgttgtggtaaaaagaagaattttttgccgatgcgatccacgtttgattttaaggaaaagagttttggtagccaatgtgtaccaaactttttaatgacccaaaaggtatctttgccatattttgctgcgatgtcaaatgcatcacgatggatatattcacctgaaatgggtagcacttcgaagtttactaacatgtggcgacgaatatcgctcaacacagaagtttgattggtgccgatatagaaaacagccgtctctttttcaagcggaaaggtgtctaaacgaaccgcaaagacagcaagttttcctgcacagcctgaggcttcatagtggcgagctgggtcggcattaaaacgagcaggggagccttcatcaacttgacgaacatagttgcagtagtaatggtcgtgaccatgtccgcaatcttgtcgaatatctttaacctgataacgtttttcttgtagattagttaaaatttcttcaggagtttctcctaaatcaatgcctaaatgattttttagttctaattcacctttttcattaagttgagcgtaaagtgccatttctgtataggctggtccacgttgaactaatgctccacctgagttgttacaaatcccaccaataactgatgcgccaatgcaagatgagccaataacagagtggggttcacgaccaaacggtttaagttgattttctaattcattgagtgtagagcctggtaagcaaataacttgggaagcgttattgatgagtttgattccgtcaattcgcattgtattgatgacgacaatatcgcgatcataatcattgccatctggtgtagagccaccagttaaacctgtattcgccgcttggtttataacaataacatcatgttcaacgcaaacttttacaatgttccaaaactcaagtagagtggcagggcgaacaacagctagggcgtttcctgttccaaatcgataaccacttcgataagcttctgttttagttggatcagtaataatataacgagatccaacaatatcggtcagtcgtgaaatgagttgttgaacagacattttattatcctcttgttataagaattagtagtactataacagaataattcccatttggataaggacattttaggctttaatcggtgtttttttggaattgctctgcatataaagaaaattctctctttatgataggttcagtgctgtatgggtatttcaatcactcaatatcagcaatgcaaaatccgttgaaacctttaaagataaagaaaaatattatttaacaaacgaaacttttactgaaatacaacctattgatatgccaaacgaacgtaatattcaaaattatcactcgacttacaacaacattcgggattggcttggttatcaaaaagctggcgaggaaaaagcaaagtcgaccatcaattaggaattgggatgaggtagtttttgaagtgaattttaagcacaataaaaaaacatcagaatttttagccgcactttctaaagtatccgctaatttacataaatgatttaaccctacctatgctgctactcttttaattttatgaacagtattttctgtttctttcatattatcttttgataattgagtaagataattaggcatggtttgtttgaataaagataaattttttaaaatttacattccgaccaaggttggcaatatcagatgatagattatcaacacatactcagggagaatggcattcaaagtatgtgaagggaaattgtttagataacagtagaatggaaagcttctttagatgttttaataactggaaaaaaagctccatgagcgtattcagaagaggctaaagactgagtcctgtaaatgacagaactcagtccttgagctaaataagtctaactttttggggtcagatcatttatcaataaactgatcaaaaaaaccgaacttaatgttcggttttcttcttcattacataatacgacgcgattgagtgtaggttctagcccaatatttttcatcaagggaacttattgtcacgccttgccctgtacttgcgtgcataaattggttattaccaatataaacaccaacgtgattatttttacggaagaaaactaaatcgccttttttaagttctgatttattaatttttctacctaaatgacgctgttcagccgtagaacgaggcaattcaataccaaaaacttcagaaaaagtagtttgcataaatgctgaacaatcaataccacgtttagtcgtaccgcccatacgatagcgagtgccaacccattcattataaacactggctagagccttatcgcccatcaaagcagaggaacggtttgttctcactttgtgaaaaatgcctgttcgattatctttttctaaattattaattaaaccagttaattgaatatcatcattttctgaaataacctgatgacttaccgttcgtggtgcattagaacaagcggttgctaatacagctaaaccaataataactaaaattcttttcaacataatttcaaataattaaaagaaataaaatttcgcagcggctatcaaaatttgaataaaattgccagtaaaaatccaattctaatggaatttttgtgatcttttacacaatgacttaatttgttccaccaacagtaatttcatcaatttttagtgctggctgtcctacgccaacaggtacactttgcccctctttaccacaaaccccgatacctaaatcaagttctgatttatctgcaaccatagaaatcttttgcatcacttcaatgccactgccaattaaagttgcgcccttaactggtttcgtgatttttcctttttcaattaaataggcttctgaagtagaaaatacaaatttaccagaggtaatatccacttgccctccaccaaagtgcggtgcataaatcccctgttttacagaagcaatcaaatcatcaaactgactttgtccagcaagcatataggtgttggtcattctaggcattggtaaatgggcataagactcacgtcgtccatttcccgttggagcaacgcccatcaaacgggcattcattttatcttgcatgtaaccttgcaaaatcccgtctttgatgagtacattgcactggcttggcacaccttcatcatcaatagttagtgaacctcgacgattttcaatcgtgccatcatccacaatcgtacataacggtgaagtcacttgctcaccaatcttgcctgtaaaaagtgaactttctttacggttaaaatcgccttctaaaccgtgacctaccgcttcgtgtagcaatacgcccggccaacccgcacctaacacaacaggcatcaatcctgcgggtgctgcaactgcactaaggtttactaaggcttgacgaaccgcttctttagcaaaaagtactgctctaatatcgccatcaacaacttcaaagaaccaatctaaaccgaaacgcccaccagaaccacaacttcctcgttcacgttttccattttcctctactaacacagaaatagataagcgaactaaaggacgaatatctgcggctaatgtgccatctgtcgccataattaatacttcttcataaacagaactgaggcttgctgaaaccttggttacacgatgatcttctgcgcgtgctgtacgatcaaccaaatgtaatagctcaatttttttctctttagtcaaactttccaaaggattaatcgccgcataacgagcaataggatttacaacattaaaagcggatagcgaaatcaaattcccctgtttgacttgcgcaattccctttaccgcctccgcacattgctgcaaagaagcaagattaatttgatccgcataagcaaaccccgttttctcaccagaaacagcccgcacaccaacgccacgatcaatatgaaaaccgccttcttttataatgccgtcttctaatacccaactttcatcttggctaagttgaaaatacagatcggcataatcaatattgcgatgcgacataatgtcaaaaatattgagtaatgtttgagttgaaagattacttggtgtcagtaatgtatttgaaacttggtttaacatattttttccagtctaaagtaaatatcttgtgagtgcttgtatccgtttaatacaacagcacagattaaaatcggattaataaagtgcggttgattttgaggttatttttccaaatgcgctaatccaaattgatacaaagcattcttcttataaccatacaactcagcaactatagctgctgcttttttaagtggcaattcttctgcaattaactcaagtgcctttaccgcttgcggcgaaatttcatcgttattgtcagactttggtttgccttccacaatcaaaaccatctcgccttttgtacgattgggatcttctaaaagccattcgcgtaaatttttaatcgtattccctgtaatcgtttcccaagttttagtcatttcacgggctaacacaatatagcgtccttcccctagcaccgcttgcatatcttctagtgtatctaaaatacggtgagtggattcataaaaaatcaaagtgcggtcttcttctgcgatattttctaatttatctttgcgtgctttacttttcgcaggtaaaaagccttcaaaacaaaatctatcagaagcaatccccgatgcacaaagagcggtaattgccgcacaagctcctggcaaaggcacaactcgaatgccagcttcacggcattggcgtactaaatgaaaaccagggtcactgattaatggcgtccccgcatcagaaatcaaggcaatattactcccctgcttgagcttttccaccaaaatatgcgctttttcttgttcgttatgatcgtgcaaagcaaaaaatggcttcttaatgccgtaatggatcaataaaagtccactatggcgagtatcttctgctgcaattaaatccacttgagcaaaagtctctaaagcacgttgggtaatatcttgtaaattgccaatgggcgtggcaacaatgtataaaattccggttaaatcagtcatttttgtttgcttttaagttatgagataagtaagatttgctacaactattgtctgtttatgatggagcaaagatgtctattctattacaaggcgaacgttttaaaaaacgtttaatgccaattttattgtcaatggctttagctggctgttcaaatctacttggtagcaatttcacgcaaaccttacaaaaagatgcaaatgcaagttctgaattttatataaacaaattagggcaaacgcaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtccaagatatcattgcgcaagcaaaacaagcggggattaaaaccttagtcggcccattactaaaacaaaatcttgatgtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaattctccacaatatcagaagttagcaaaatccacggggggtgaatatcaattgatgcgtttatatgcaatgggtgcagatgcgtggttgctcattaatcaatttaatgaattacgccaagtgccaggctatcgcttgagtggcttaacagggattttaagtgctgataccaactgtaatgttgaacgcgatatgacttggtatcaatatcaagatggtgcaattgtaccagttgcaaactaatgttttctttaaaacgtcagcaaggggcgagctttgagcatcaagctcgcctttttttagaatcaaaaggcttaacatttattgcggctaatcaaaatttcaaatgtggtgaacttgatctaataatgaatgacaaagaaactatcgtctttgttgaagttcgccaacgaagtcattccgcctatggttctgctatagaaagcgtagattggcgaaaacaacaaaaatggttagatgccgcaaatttatggcttgcaaaacaaaatatgagcttagaagatgctaattgccgctttgatttaatcgcttttggcaaaacacctcaagatattcaatggattcctaattttctcgattaatggctttttataatgttacaaaaagtaaaagatatttatagcgaaagtattcaaattcaaattgcagcatctagcatgctttctgaaaatattaccaatgccacacaaatggtaatgcaatgtttattaggcggtaataaggttatcgcctgtggcgtgtcgcgttcttatgccaatgcacagtttctcgtctcaaacttacttaatcgatatgatttagttagaccaagcttcccgtctgtgttattgagcttagaaagtgcagtgggttcttcacttgtttttgaacaaccgcctgaagaattgtattgtcatcaatttaatgccattgcaaaatcgggcgacttacttattgcttttgcacctttggggacagaaaaaatcgtgctaaatattatttctcatgctgtcagcaaagaagttaatgttattgtgctaactggctctaacaacgatgccattcaaggaattttagcagataaggatctagaaatatcaatcccagccaccaaagaaagtcgtatcttagagaaccatctttttgtgattaatgcactttgtgaattggttgatcagactttattcccaagtgcttgacaggaaaataaatcactttcaaactaatagtaatttaatctaaaaaggagttaattatgacattatccccgttaaaaaaactcgctatcctgcttggagcgactatttttctacaaggctgtgttgcagctgtgattggaggtggtgctgtagcagctaaagtagctaccgatccccgaacgacagggacacaaattgatgatgaaaccctcgaatttaaagtagaaaatgctgtagaaaaagatgcccaaattaaggctgaaggtcgtgtaaatgcagtgtcttacaatggccgagtacttttaataggtcaagttcctaatagtgatgtaaaagacactgccacagctcttgcaaagggtgttgaaggtgtcaatgaagtttataatgaactaactgttagcccaaaaatctcttttgcacaaatcagtaaagatagttggctcacaacgcaagtcaaatctaagatgttcgttgatggtcgagttaaagccacagatgtcaaagtgattagtgaaaatggagaagtatttttactgggtaacgtcacacaatctcaagccaatgcggcagccgacattgccagcaaaatcagcggcgtgaaaaaagtaattaaagtattcaaatacctagactaatccttcaaagtgcggtgaaaaattcaacaaatttttaccgcactttttcttatttttctaaataaaaaattttaatttttattctcacaaaaaccgtttatttttaaataagttatctattgtcaagaatcaaatcaaaaaatttattacttgcgatcttttctcaaacacattatcttgtgcatcgttttcataaaaacactatatcttgtgttttaaatcctgttttaaataacaacaagaaggctaatacaatgaataaaagtttaatggttacaaagcgtgacggtacgcaagaacaaatcaatcttgataaaatccatcgtgtgattacgtgggctgctgaaggactagacaatgtttctgtttctcaagtagaacttcgttcacatattcaattttatgaaggcattcgcacttcagacatccacgaaaccattattaaagcagccgcagatttaatcagcaaagattcgccagattatcaatatttagctgctcgtttagcgattttccatttacgtaaaaaagcctatggtcatttcgatccccctcgtttatacgatcacgtcaaaaaactagtacgtatggaaaaatatgatcaagcgttattagatgattatactcgtgaagaatgggacacaatggacggcttcatcgatcattggcgtgatatgacgttttcttatgctgcagtgaagcaattggagggtaaatatttagtacaaaaccgtgtgacgggagaaatctacgagtctgcacaattcttatatttgctggtttccgcaagtctattctctaaatatccaaaagaaacacgtttggattatgtaaaacgtttctacgatgccacatcgactttcaaaatttccttacctacaccaattatggcgggcgtgcgtacaccaactcgtcagttcagctcttgcgtattaattgaatgtgatgacagtttagattcaatcaatgcaacagcatcagctattgtaaaatatgtttcacaacgtgcagggattggtattaatgcaggggctattcgtgcattaggtagcgaaattcgtggtggagaagcattccatacaggttgtattccattctataaatatttccaaactgcagttaaatcttgctcacaaggtggcgttcgtggcggtgcagcaacactttattacccaatttggcacttagaagcagaaaacttgctcgtattaaaaaataaccgtggtgtagaagacaaccgtgttcgtcatatggattatggcgtccagttaaacaaattaatgtatcaacgtttaattaaaggtggcgagattactttatttagtccatcagatgtacctggactttatgaagcattctttgcggatcaagataaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcttttaacttaggtaaaattgaaaacttagatgaattagaagaacttgcggatcttgcagtgcgttcacttgatgccttattagactatcaagattaccctgttgtggcagcaaaacgtagctcacttgcacgccgttcactcggtattggggtcattaactatgcgtattaccttgcgaaaaatggtgttcgctattctgatggttcagccaacgatttaacacaccgcacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccgcgtggacacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttaaacgcccctattgtcttccccaacttatggggaagatagcacgacataacgaattaggatactttcctcagtctttgatagtttcccctgataaacagggaaagctaaataaatgataagttctatttaaaggataaataaaatggcatacactactttttcccaaaataaaaacgatcaattaaaagaaccgatgttctttggtcaaaacgttaatgttgcgcgttacgatcaacaaaaatacgagacttttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggtcgtagcccgaacgtggcattattgcctttagtgtcgattcctgaattagaaacttggattgaaacttggacattctctgaaaccatccactctcgctcttacacacatattattcgtaatattgtgaacgatccttctatcgtatttgatgacatcgtaactaacgaagaaatcatcaaacgtgcacaagatatttcatcttactacgatgatttaatccgtgatagccaactttatggcttatacggcgaaggcacttataccgtagatggcaaagaatgcgtcgtaactttacgtagtttgaaaaaacaactttacctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtaggtcaaattgactcaaaagttgatacgaatgattttgacgatttttctctctaattaaaaacacataaaaaactaaccgcactttggaatattctttttaaatatttaaagtgcggttaattttttattcattttaaaaggctttctaacacagaaagccttttatttcttagatttctaataacaatcttgttggatcttccaataattctttaatcgttaccaagaaaccaacagattcacggccgtcaattaaacgatgatcgtaagataaagcaaggtacatcataggatgaatcacaacttgaccattaagcgcaatcgggcgttctttaatagcgtgcattcctaaaatcgcactttgtggtggattgataattggagtggacataagagaaccgaacacgccaccatttgtaatagtaaaattgccgccagtaagatcttctactgttaatttgccatcacgacctttttcagctaatgctttaatttgtttttcgatctctgccatactgagcttatcgcaatcacgaagcactggtgtgactaatccacgtggtgttgaaactgcaatactaatatcaaaatagttatggtaaacaacatcatccccatcaatagaagcattcacttcaggataacgttttaatgcttccacaaccgctttaatataaaaagacataaagcctaaacggacaccatactgtttttcaaatttttcgccgtaggttttacgcaaagtcattatcggctgcatatccacttcattgaaagtagtaagcattgctgtactatttttggcttcaagtaaacgttcagcaatacgtttacgcaaacgggtcattggcacacgtttttcagaacgtgcgctataagccaccgtactaattgtattttgctcagtggcagcttcttgtttcacttgctgtgcttgtcgttttgcaatttcacgttcaatatcttcacgtgttaaacgaccacccacacccgaaccttgaatttgatctgcttgtaaatcatgttctgctaataaacgacgaattgcagggctctgatccgcattatgattatgactattttcaatcgctgcattttgacgatcagatggtgtgggttcattcgttgcttttaacgtcgctgaactgacatctccttcttgagccgtagaaattttgcctagcaactgtttactcaccactgtttcgccctcagcttgaacaacttcagccagtacaccatcagaaagtgcgggaacttctagcacgactttatccgtttcaatttccacaataacctcatcacgtttcacagtatcgcccagttttttatgccaagtggcaacagttgcatctgcaactgattcaggtaggtctggaacaagaatttcgattgtcattttatttttccttttcttcttttttactatatcttaattatcttggctcccctatttacagaggaaagcaaagataaaaacctttattaaattaaccgcactttaaaaactcaacgcatcttccactaactgtttttgctgtttagtgtgaagcgacatataacccacagcaggcgaagcagaagctggacgccctgcatatttgagtttaacggattctggaattgctgattcaaaattatgtttgctgcaataccaagccccttggttaagtggttcttcttggcaccatacataatccgtgacatgcgcataaggctcaagcgctttcttcacatcctcatgcgggaatggataaagctgctcaatacgaataatcgctacatctttctgattatttgcacgacgttgttcaagtacatcgtaataaactttacctgaacacattaccacacgttttacatctttaggatcaagctcatcaatttctccgattaccgtttggaaagttccattaatcaactcgtctaaactggacactgccaatggatgacgtagtaaagattttggggaaatggcaatcaatggacggcgcattttacgtaaagactggcggcgcaacatatggtacacctgtgcaggtgttgatggcacgcaaacttgcatattttgttctgcgcaaagttgcaaataacgttcaagacgtgcggaagaatgttcagggccttgtccctcatagccatgaggcaataacataactaaaccacacattctgccccatttttgttcgccagagctaataaattggtcgataacaatttgcgcaccattagcaaaatcgccaaattgcgcttcccaaatggttaaagtttttggatctgttgttgcgtagccatattcaaaagcaagaacagattcttcagaaagtaccgaatcccatacttcaaaacgaccttgattggcgtgtaaatgtgttaatggtacataccccgtaccatcattttgattatgcacaacggcatgacgatggaaaaaagtacctcgtcccgcatcttcgcctgataaacgaacattaacaccttcatcaagtaaggttgcataagccatggtttcagccataccccagtcgagcaatttttcgccttgatacattgctttacgatcattatagattttttctacacgagggtgcgcacgtaaactttctggatattcacatacacgtttagcaagcgttaaaaaacgttcctgtgaaaatttgctttcatacggtgcagtccaatcataattgagatattgcaaccaatccatttttgccgtatccatttctcgccattcagataccacgcgatcgccattatctagcgcatcgcgataatcattcgccatctcggtaacttgttcttcagtcatcacgccttctgaaactaagcgatctgcataaactttacgcggtgtaggatgttttttgatgatgctatacatcattggttgagtggctaatggttcatctgcctcgttatggccatggcgacgataagaaattaaatcaataaaaatatctcgtttgaataaattacgatattccaccgccatacgcgcagtaaatgccaccgcttcaggatcatcgccattaacatgaataatcggtgcttgaatcattttcgcaatatcggtgcaatattctgtagagcgcgtgtcattcggattagatgtcgtaaaaccaatttggttattaatcacgatgcgaatagtaccgcccacactgtaaccacgggcatttgacatattcaatgtttcttgaacaaccccctgtcctgccacagctgaatctccgtgaacagtaatagcaagcactttgctatgttctgtatcattcatacgagtttgtcgagatcgaacagaaccaatcacaacagggcttacgatttccaaatgagatggattaaatgccaacgttaagtggactctcttatcatctacggcaaaatcagaagaaaaaccttgatgatatttcacatcccccgtacgttcgctggaatgtttacctgcaaattcatcgaataaattttcaggctttttacctaatacattcacgagcatattcaaacgcccacggtgtgccattcccattaccacatcatttaccccttgacgactagaatggcgaataatttctttcatcaatggaataaacgcatcacttccttctaaagaaaagcgtttcgccccagggaatttcgcaccaagataacgttctaaaccgtctgcagctgtcagttcacgaagaaaattgacacgttcttcagatgtaaaaagcggtttatctaacaggctttccatcttgctctggagccacattttctgctccatatcctgcacgtgcataaactccaagccaattgagccacaatatgtttctttcaacatttgagctaattcgccaagtttaatggtatcgcgtttataaacgtaatgatttatattgaaagtttcgttgagatcttgttcagtaaaaccgtgatggcgataatctaattcagggacagaagatactttccaacgataataattgagaggatcaagattagcctctaaatggccacgaaaacgataggcattgataaattgtagaactttcactaattttgcaccagcagcaggatctatcactgtcaccgcttcattatgattttctcgcgctaaacgacgaaaataatctcgcactggagtatggggctgttcaagtgcggtggtttttggcaaagaatcaaaggtttttcgccagctttcctccaccgactgtggatcactcaaatagctttcataaagttcttctatataggattgatttgcaccgcctaatgctgtgctggctaaccaatcatcaaatgccttgttctgctgcataattacctctttattatgatatttgaagcaatattttcgctccattttttacgcattatacataggattgcaacggaaataagcctcttatcagaaattgttacaaatttgtgatctagttcaaactctttagatttcaaacaataaaaaaccgcacttcatctcttaaacaaagtgcggttatttttacttgtattaaaatttaggatttagaatttaaaaatggattgctccgcttttcttgcccaatggttgtgtaagatccgtgtccagcaataataataagatcgtcattcaatggtaatagttttgttcgaattgaagaaatcaatgtttcataatccccgcgagggaaatcggtacgaccaattccgccttgaaataatacatcgcctgtaaatgccacttttttctcgtgttcaataaaaccaatatgcccaggtgtatgccctggtaaatgtaaaatctcgaaattaaagccatctaattttaagatttcaccttcttgattaaaccaacgatcaggtaaaaaggcttcaatatttggcaagccaaaacgttgggcttgttcgggtaaactctcaaataaaaatttatctttttcattagaaccccaaatttcaacgccaaaatgttgttttaattgcattgcagcaccaacgtgatctaaatggccatgggtaatcaaaatcactttgagatttaaatccagttcttcaatacgttgaattaggcgttcggcttcgccacctgggtcaataattgcggcatttttgtcatcatcccaaatcaaagaacaattttgttgaaatgcggtaacagggataatttcaatattcatttttgctccttataattgataaaactgttgagtattcaaaagcatttgcttttgaacagaatgtaatggcaaagactttaattcagctagtttttgcaagactgccaataattgttcagaaatgcccgcacgttcaaatccttcgtgttgccaagggctatccgtttcaatcatcaagcgatttaagggtaaatgttgtgcgacatattgggttttatggttccataaaatatcaggggttaggcttgcaaaatagggggtagagaaaaatttctgaaaagatttttcatctgtcttaaaccagtgaaagtgagcccgttgaattttgtgtttctgcaataattcaagggcaatttctacatcgttatgtacaatatgcaaatttaacggtaaatcccattttttcgctatcagaataaatcgttccagtaattcaatgtaaggcacgtaatctaaattcggattttctcgtttagaataatgtggcaagcccacctcgccaatggcagaaatcgatgaataatgttcgtcaatccattgaaataattctttttgttcttctaaactaggtaattgctgttcaggatgaaaaccagctgcaatataaagtttctttgggtaagtctgttttaaattcagcagttttttggcactgttgagattagtactcaccgcaagcatacctataatctttgaatgagcaagtgtttgctgaatattctcatcagagagttggtctaaatgaagatggctgtcaaataacatatcttttccaatgaaaaaccgcacaaaagtgcggttaattttacatttgttttacacgcctttccaagttctcacaggacctgtatctacgtgaatgaaattactagttggataataacccacgccaccatttcgcagactttccgcagaagatttcactttaatcaaaggcacacccgcaatacgaaaatcaatggcttttcctttaatgtgataactatttttcgctacgccacgactttggcgacgacgcattgcattagtagcgaccgaacgataaccacaaattacttcaatttcagcatcgcgtaagcctaaattagtttggatattataaaatttatggaataaatttggatccattttatgcacttgatttgtccttttatcacgcattaaataatccaatttttttaacatcgcaggcgaaaaaccttttgctaaagaaaactcgccacttaatctttcgcccgtattaatgttgcggaaagttaaaatacgaggtttaggtgttgaaaccattgctaatacagaatttggtaaaatagatattcctaacgcaataccgcccagcgataaccattttcgtttattttgatccacataattcattatagctcccttattttattgaagatatttttttacgagatcccaatttatctcagcaagattaatctgacgatcataaccataaatatcaggtaaatttacaatatttccgttttcaatccacgcagtaacataatataaaaaaacaggattatccgagcgtatcggcgcagaagtggtttttttacttgctaatactgtattttttcgagtttctgtccaacctgcttcttttaataaaatacttgccaattgatcagatttttcaacacgcacacaaccagaacttaacgctcgatttttacgattaaacaatccgcgatttggcgtatcgtgtaaataaattgcatcagaacttggcatattaaatttataattacctaacgcactatcgccagccgcttgtcgaactcgataaggaaatttattaccaatagattcccaatcaatagaagcaggatcaacaacattgccttgattatctaaaattgaataattatgctccgtaatataatttggatcggctttcatttttggcaataaatcttcattaattaagcgaattggcgcattccaaggtggatttacaaccacattacttaatttgctatacattacaggtgtcctgcgcgaatctgtgccaacaattacccgagattctaaaattaaatcgccatcacgataatactgtaatttatagcttggaatattcacaaaaattccattatgaaaatcaggaatcacacgtaaacgctgtgcattcattgccaatttttgagcaatatttgattctttagaagtcggaataaacatcggcaatgattgaactgtttggcgatataaatgattttctcccgctaaactttgtatgaaatcaagaagttgattattttccaccgcacttaaccagcgttgaatatgatcattttcaggctgttgtgcttgatactgagcagatgaatacaaccaattagatgcttgagaacgaacattttgtgtgtaatataagtaatctaacaaaatatcacttaataacacatcataaaccaatccgccttgttgttctaccaatgccaatgtttctagtgaagttgccgacgattttgaaataccgcttgccaccattgccgcataatcacgtaacaattgacgagctgccgcattgtcagtccataacggggcatatttacgagaagcatataaacgcgcgagtaaaggcttaaattgtaacttatgatcgcctatttcgtgtgttagcgtcatattaagcaatgtttgtttttcttccgttaaacgttgctgatccgcataaatggcttcttcaagctcttttctttctgcgagtgacaaatgggaaagattaatgccgtacaatgatttagattggtcatttttgctcaaacctactaaaacacaacccgacatcatcatagataatgataaggcgaataatgataactttaaggtgcttttaaacactaccatttcctaaacctttattaaaatcaccgcacttgttgcttttctcaaacaaagtgcggtcaaaaccatttagtatttattttttactttccgtttttgcttcggataggccgtttgcttgattaattttctgatctgaattaaaaataacgaaatcagctgctattttttcagcttcttttaagaagaaatctggtgcttcgtaatctttcggcaaatcatcaatatctttcaatgctttcttaccctcacgtttaaaacgttcgttcaaatcttttaaacgtcttgcatcatctttatcattctctgctttacgcattttataattcaacgatagaaattttcgatctcggcgttcatttcgcactttcaattcttcattcaatgcaacaaattcaggatctttagcaatacgagcaagatgtttttcatttagaatatttactgcattatcaatataatcgatatttcctacttccgtataactcgctgatgggattttatcccaagcaagcgcattatcttctttatcttccccatattctttcgcatctataatttcagggaaattaatatcggctgcaacaccttttaattgggttgaaccaccattaacgcgataaaatttttgaatagtatattgcaaaacacccaacggactctgatctaaatcatagataaaatttaacgaacgactctgttgcaccgtacctttaccaaaagtattttgcccgatgataatacctcgacgataatcttgcattgctgcagcaaaaatttctgatgcggaagcactgtaacgattaatcatcacaaataataaccccttatattgttgcgtagcatcatcatcttcatgaacacgaatacgctgataagcatcgcgaacctgcacaacagggccatcggcaataaataaaccacttaacgccaccgcttccgttaatgcaccaccgccattttcacgtaaatcaacaataagagcctcagctttttgattttctaatttaaccagtagttttttgacatcttcggttaatccaatataaaaacttggaatttttattaccgcaatgttttttcctgacactttttcaaaggttagtttagcagcttgatcttcaatacggactttatcacgaaccaaagtaataatacgtgattttccccctttagcaggctcaatttctaagcgaactttagtgccttttttccctttaattttttctaccaaatcttctaaacgccaaccaacaacgtcttcaatatcgcctgttgcttgcccaacaccaatgattttatccccaggatgcagctttttactacgttccgctggcgcaccaggtacaagagatttgatgctaatttcatcatcttctgattgtaaagtagtcccaatgccttccaaagaaagatttatactttcattaaaactttttgctgttcttggggaaagataactggtgtgaggatcaatttcacgcgcaaaagcattcaaataaatttgaacaatatcgtctgcttttgtttgcgttaaacgacgaatggctaaattatagcgttttgtaagctttgctttgatttctgaccattttttatcttttaatttaagattaataatgtcattttttacacgagcatcccaaagtttattcgcatcagcttcagtttgtggcgcagccgctttttcacgatcaatttcaatttgatcttgaccatttaaatcaggctctttatctaataaagataacgcataagtataacgttcatagcgacgtttcatcattacatcataaatgtcaaacgccgcagaaagatcgccttgactcaactgttcatctaacttagtaccatatttttgacgaagttcgtctatatcagactgcaaaaaagtattgtggctaaaatctaaatttttaatataacgatcaaaaattttctcggaaaaatcatcatctaatttaatcttacgataatgggattgagttaatcttgtcgttgcacgcttagttgccaactggctttcttcacttatcgctggaatactaatgtcacttggttttaatgtaggttgtacagcaaatgcaggaattgcactgctcaaacacaccgataaccacgcataacaaatcacattttttgacattttaaatttcataaccatttccgagtcaatttttatttattaagcaaataaacgatctgcagcaacgttcataatcaaaccgttttcaagttcaacacgtgctgaatcttttaatacttctaccactgttgcttttttagcattatctccagctttaactttcacaacagaaccaacagaaatttgtgaaaaatcaaccgcacttagtgataatttactctcttttttaaggtttttattcgcaggtttacgcggatgctttttttgttgtgcttttttagctacagcttctgctttacgtttttccgcaaaacgcgctttcgcttcagcaagttgctgtgcagcgtgagcaacgtgttctgcatctaatacacccgcaggattaccctgtaaatcaacacgcactgcaccttcacgacagccatataaataacgccaatttgatgtgtattggcgaagagcctgacgcaattgggttttacttacgcgttcatcatcttgtaatgcttcagctaaatcttgaaataaacctatttttaatggttttgcttcgccctctaaaacaaagcaaagaggaaatttttctgctaaataagtaatgatagcttttgcgttggttaatttttgcacttccgtttgcacatctgtaacttgagatgataattgtgtgtcagtcatagttatatccttgaggctattaataaaataaagatttgcctagtttatcgcactttttacaaaattaacaacggatcccgttatgctgaataaatttcacacaaaaataacgccaagacttcacaaatacgttaaaacaacgatagaatggcacgtttttgatttataaagaaagaccacaagcgtgcctaaaacaaagctaacttcgcctccatttaaaattttaaaatgcacagaatgtgatgcttgcattaacgtgccttctattcttcaatcaaatgaacaagccgaatgcccacgttgtcatcatctattagaaagtagtacgaggtggtcattacatcgttgtgcaatgattgcattatctattttgatattaatgcccttttccttgaattaccccttattaagtttacatttattgggtattaaaattgatgcctctatttgggatggcatttggaaaatggcagtgggtggttatgaatacactgcgtttatgatctttatttgtgcagtagtaatgccgattacgtttgcacttttagtgattatgctttggctggctaagatttttcagataaaacctcgtagtgttttactatttcttggttacattaaagcttgggtaatgtttgatgtttatttagtggcactcggagtaaccatatttaaagtacgcgaatatgcaacattagaaattaatatttatttaattccttttatttttaccgcacttttaactacgttgctttttatcaaacttaatctttccgccttatggcaggaattttatcctgaatgcacttcagtttatacaaaacaagctgttgaattatgtcctgcttgccactacacctttacgcaaaaatctatctattacgatcatcaacaaaagatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggtgcattttattttggtgcagccgtattttgcactatgctttccacctcacaatttgatagcaaattaatttggaaaatttatgacagagaaaaataattcctcctcaatagaagaaaaatatcaagaaataacagcgaacttacgtaaaacaaaacgcatttcgcctttttggctattgccttttatcgcattatgtatcggggcaattttattcttccaaattgtgaaagaacgtggtactagcattacgattacctttaccaatggttcaggtatcgttgcggataaaactcaaattcgttatcaaggattacaaattggcatagtaaaagaagttcatttcactgataacctgcaaaaagtggaagttgttgccaatatcaatcctgaagcatcaagtattttgcgtgaaaatacaaaattttggcttgtgcaaccaaatgtttctcttgctggcatttcaggattagattctctcgtgtcaggtaattacatcactcttcaaccgggtgatggcgatcgtgaagatgaatttatagcagaagaacaaggccctattgcacaagtttccgcaggagatttattgattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatgttagtggcattaacgcgaacattagcccatcaggcttaaacctaaatgtagaaagtttaaatgccgttgtacagggggcggtttcttttgactctccagctgacagcccaaaagcagatgaaaatagtcatttcacgctctataccaatttaaaagcggctaaacgtgggattgaaattaaggtaacaattcctgcctcatccgctcttattgcagggcaaacggaagtttattctcaagataatgctatagggattctcgccaagctaagtgcggtggaaaataacgatgaaattttagaaggcagtttattgatcgatccaaaccaagcctctttgtttaaagcaaatagtaaaattgtcctacgcaataaaaaaatggatctaggcaatttagcagaaccaaaaaaattctttcgtgacgaatattttgatgtgattgcgggagacggcgaaactaaacatcaatttaacgtgattaaagaaaatgaattattactcaatgcgcctaacacgttagttttaaccctcactgcgccagagaattacggcgtcagcgaagggcaaaatgtgttttataacaatatgataattgggcaaattgtttcacaaacaattgatgtaaatggcgtgcaatttaaagcagcaattgcctctgaataccgtaatttaattcacgaagatactcaatttgtggctgcaaccaatttcgatataagcattggattagatggattgcgttttgaatccgcgacaccagaaaaatggttacaaggtggtgttcgagtactaacaaaacaagctcagggaaaagctaaaaccagttatccactttatcaaaatattagcaatgcagaacacggtattacaggcgatattcttacgccaacaataaccttacatacccaaacattaccaagtattgataaaggttctctcgtactatatcgtcaatttgaagtaggaaaaattttaagtattaaacctaaaacgaatagctttgatgtagaaatttatatttatcctgcctatcaacatttattgacagataaaagccgtttttgggtagaaagtgcggcaaaaatagatgtcagtccaaaaggtattagtattcaagcaacgccacttgcacgttccttaaaaggggcgattagctttgataatggcggttcaggcaataatcgaacactttatgcaaatgaaagctatgcaaaatccatcgggtttgtcatcacgttaatcacagatgatgcaactaatcttagcaaaggaatgaatctgcgctatcttggcttagatgtggggcaaattgacagcattcatcttgatgcaaaagcgaaacgcatcactgcaaaagccctaataaatccaaattatatgaatataattgcaaaagaaggggctaattttacgataatctcgccacaaatttcggctggtggaatagataaccttgatagtttattacagccttatattgatattgaaattggtaatggaaacacaaaaacacaatttaatttagcacaaacggcaccacaacgtaataaatttagcaatggcacgccgtttattttagaaacgcgtgatgcgatgaatttaagtgaaggttcgccaattctttatcgaggtgtagaagttggcacagtgaagaaatttgaacttaatagtcttggtgatcgtgtgttagtgcatattgccattatgccgaaatatagccatcttgttcgacaaaacacagaattttggatcgcatcaggctacgactttagcttaggctggaaaggtgcggtatttaatacgggtagcgttcagcagttgctaaaaggtgggatttctttctccacaccagcagaaaaagaaattcaaccgcaagcgcagcccaacaaacgtttcttgcttcaaataaaccgccctgaagaagtgcaaacttggggaagtggtgcgttatcaaaatataacataaatgaaaatatttaatctgcaccttaatgaattagggtgcaggtaagcgattaccatttttctaatgcttctttatcgctctctcttgcttcaatccaacgctcgccttgattggtttgttcttttttccagaacggagctttggattttaaaaaatccataatgaattcattggcgtgataagcatctccacgatgtgcggaacttacccccactaaaacaatttcatcgccagtttgtaaaagcccaacacgatgaattaccgatacacgttgaatatcccaacgcgctgtcgcttgtgcaacaatttcattcaacgctttttcagtcattgcgggataatgttctaaatacaaactagatactgcatcgcctaaattaagatcgcgtactttaccaacaaatataaccgttgcaccaaccgaatgttgttcagaaagccattgataaacggcattttgatcaaaaggctgttcttgtaccgaaatttgaatatccgtcatttagccccctgttactggtgggaaaaaggcaatttcatcgccattttttaccgcactttctaaaggcattaaggtttgattaattgccactaaaagtttacctttttccagtgccaatgcccacttatcgcctttttgagcaaggtgttcacgcaccgcttccgcagtggcaaaatcatcttctaattgaatggcatcaacgccaattaattcacgagtttgagcaaaaaataaaatatttaacatcttatttttcctccgcaataaaatggcctgattttccaccgcacttttctaacaggcgaacttgctcaatcacaatgtctttctgcacagctttacacatatcgtaaatggttaaggctgctacgcttgcggcagttagtgcttccatttctacgccagtttttccagttaatttgcaaagagattgaatacgaacttgattggtttcaagtaacggttctaaatttacttccactttggaaagtaacaacggatggcaaagcgggataagctcccaagtacgttttgcagcttgaatacccgcaatacgagccgtagcaaaaacatcgcctttgtgatgtttaccttccacgatcatagcaagggtttctttagacatggtaacgatggcttcagcatgggcttcacgaactgtctctgcctttgcagaaacatccaccatattggcttcgccttgagaattgatatgtgtaaatgtagtcataatataataaaagtgcggttaaaatattaaatgttttaaataagcgacaaaaggaagcagatgaatattaccattcatctcactttgctttttatccaccaatagaagctaaatgatttcttacaccagtatcgccgatatgcaaataatgatgttcacgtttgccttgcagtgcggcaaaaatacgtgcttgtaaaatagcttgctgttcgtgtgactgcaataaatcacgtaattcaatgccttcttcgccgaataaacaaagatgaagtttgcccttcgctgacactcttaaacgattgcaacttgcgcaaaaattcttttcataaggcataattaaaccaatttcgcccgcataatcaggatgtgtaaagactttagcagggccatccgtgtgggatttatgctgtaatgtccaaccatttttcagcaatttatccgctaagatttgtccagaaagatggtatctatcaaagaaactatccatttcgcccgtttgcatcaactcaataaagcgcatttgaattgggcgatgttttacccaagcaaggaattgctcaaactctttgtcattcagatttttcattaaaactgaattaactttgactttattgtaacccacttcaaatgcacgatcgataccacgcatcacgtcatcaaatttattgatacctgtaatttgatggaacattttcggatcaaggctatcaacactaacgttaatagacgtaatccctgcttgcttccaatcagccacatcttttgccatgcgatagccgtttgtcgtgacggctaattgacgaatgccatcaatgttagcaatgctttcggcaatagaaataaaatctttgcgtaaagtcggttcgccacccgttaaacggattttctctgtgcccatttcagcaaacgcttgagcaagatggataatttcttttaaggttaagaaacttggtttgttagcttcgggttgataaccatcaggtaaacaataggtacaacgaaaattacactgatcagtaatcgacagtcgtagatagtaatattgacgttggaaaggatcgactaagcgagactctcctacgttcttgataggaatggattgcattttacacctttctaaatatggagaggataaaccgtttccagcgtatccctgaataacacacggcgttattggcttgccaccgtatttcttctgaaacttaggctaaacaagctcggagttatgcgttaaatttgatttgtcgtcattctaaaagatttcacttcataaacacaatcaataatattgatgaaaatcagtattttcctaaattcttaaaaatcaattatataaaaaaatacataatgaatttaaagctggctcattagtgataattaatcctatttatattaataaccataaatttttagctgattattatgaggtatttttattgatttaaatcataatttaatcaataaataaatttctctacttttcataatcagaaaaatatcctaccatttttatcggatttatttttactaatcaatataggagtgatttatgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaaataaagcagaaaataatgataaagattggacttcggcatcttatgcggagatgatcgatcacattattactcgttttcataatcgccaccgtgaacaactccctgaattaattacattggcggagaaagtagaaaatgtacatagtgatcgtgatgactgtcctatcggcgtaaccgcacagttagaaaaaatttatgctgaacttagccagcatttaatgaaagaagaacaaattttgttcccaatgatcaaaatgggaattatgctatggcctcaatgccaattcgtgtaatggaaatggaacacgatgaagcgggacaagatgtggaagtgatcaaatcacttactaacaattgcacgccacctgcagatgcttgtttcagttggaaagctttatatagcggtattaatgaatttattgatgatttaatgcaccatattcatttggaaaataatattttatttccacgtgtattaaacgaaaaataattcaatattcatcaaaaaataaccgcactttaatctattccgaaaaacaaactaaagtgcggtcatttctataaaaattttgagttggtcgataagccgagttctgtcgtggacaatcattcctctaggcaacaaattactctgccgctcaagcaacctacccgaactctggacgggccacccattgagttcctatttggtcttgctacgagtggagtttaccctgctgccaaccgttaccggaggcacggtgcgctcttaccgcaccctttcacccttaccgtttacacggcggtctgctctctgttgcactggtcgtcggctcacgccgcccggacgttatccggcactctgccctgtgtagctcggactttcctctcgtttacttgtcccactaggtcgtataaatacggttaagggcttcaataaaccagcgattgtctaaccaactcggcgcgtagtataggggcaatcactagtgcggtcaataaaatccccaatttttgaatattgcttcatcaatcttataaacaataatgcctaatttttcattcgtatttttttatgattccgctaaaataacgccaatttcaaccgcacttttaggaagaaaaatgaactatctaaaaattgcacaggattccctttcagtggaaagtaacgcacttttgcaactcagccagcgtttaggcgaggattttaatcaagtcatcgatcttattttagcctgcgaaggacgtttggtaatcggagggataggaaaatcgggtttaatcggcaaaaaaatggtggctacctttgcctctacgggtacaccaagtttctttttacatcctacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtgtgtccaaataatctcgcgccaacaacatccgcacttgtcacactggcacttggtgatgcactcgccgtatcgcttattacggcacgcaatttccaaccagctgactttgctaaattccatccaggtggcagtcttggtcgtcgtttattatgtaaagtgaaagatcaaatgcaaactcgcctaccaaccattttacccaataccaattttacagattgtctgaccgtgatgaatgaagggcgaatgggcgttgccttagtgatggaaaatgaacaacttaaaggcattatcactgatggcgatattcgccgcgcgcttacagccaatggtgcagaaacactgaataaaacagccaaagactttatgacaagttcaccaaaaactattcatcaagacgaatttttatcaaaagcagaagactttatgaaagcgaaaaaaattcactcgctagtggttgttaatgatgaaaatcacgtggtgggtttagtggaattttcaagctaaggaatcccaatgcaacaaaaattagaaaatattaaatttgtcattactgatgtagatggcgtgctcaccgatggacaacttcattatgacgccaatggcgaagccatcaaaagttttcacgtgcgcgatggtttaggcataaaaatgctgatggatgcaggtattcaagtggcagtgctttctggtcgcgactcccctattttacgtcgtcgcattgccgatcttggtattaaattattctttcttggcaaacttgaaaaagaaaccgcttgttttgatcttatgaaacaagcaggcgtcactgccgatcagaccgcttatattggcgatgatagtgtagatctccccgcctttgctgtttgtggtgcttcttttgcagtggctgatgcccctatttatgtgaaaaatactgttgatcatgtactttccaccaatggcggcaaaggggctttccgtgaaatgtccgatatgattttacaagcgcagggaaaatcctctgtgtttgataccgcccaaggtttcctaaaatcagtgaaaaatatggggcaataataactcattcgtcagtgttattgcttagtaaaacgaagtaaccgcaaatattgcctatttaaattaactgtttaaatatacaatgcaatagaaataaatcaagatttttgtgatgacaaacaacaattacaacagcttctttgcaatctatatgcaaatattttaaaaaaatagtataaatccgccatataaaatggtataatctttcatctttcatctttcatctttcatctttcatctttcatctttcatctttcatctttcatctttcatctttcatctttcatctttcatctttcatctttcatctttcatctttcacatgaaatgatgaaccgagggaagggagggaggggcaagaatgaagagggagctgaatgaacgcaaatgataaagtaatttaattgttcaactaaccttaggagaaaatatgaacaagatatatcgtctcaaattcagcaaacgcctgaatgctttggttgctgtgtctgaattgacacggggttgtgaccattccacagaaaaaggcagtgaaaaacctgttcgtacgaaagtacgccacttggcgttaaagccactttccgctatattgctatctttgggcatggcatccattccgcaatctgttttagcgagcggtttacagggaatgagcgtcgtacacggtacagcaaccatgcaagtagacggcaataaaaccactatccgtaatagcgtcaatgctatcatcaattggaaacaatttaacatcgaccaaaatgaaatggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatccggataatgttaccattagcaatggtaacgatgatcaatctcaattaaaggacgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatggggtttttaaatattaccgctgggggttctgtagcttttgaaaaggcagggggtgataaaggccgtgctgcaagtgatgctaaaattgttgctcagggtgtaattactgcaggcagtggtcaagatttccgttttaataatgtatcactaaatggaactggtagagggttgaaattcattacagctaaaggaaataaaggtaatttctcagccaaatttgatggtgtgttaaatatttcaggtaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttaactgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtggaagtaaccgctaaaacaggtgacattaaaggtggaattgagtccaagtctggcggagtaacacttactgcaaccggagatactcttgctgtaggtaatatttcgggtaacactgttagtgttactgcaaatagcggtacattaaccaccaaagcagactctacaatcaaaggaaccgggagcgtaaccaccttaagtcaatcaggcgatatcggcggtacgatttctggtaagacagtaagtgttacagcaaccaccgacagtttaactgttaaaggtggcgcaaaaattaatgcgacagaaggaactgcaaccttaactgcatcatcgggcaaattaaccaccgaggctagctcaagcatcacttcagccaagggtcaggtagacctttcagctcgggatggcaatattggaggaagtattaatgctgctaatgtgacattaaataccacaggcactttaactaccgtgaagggttcaagcattaacgcaaacagcggcaccttggttattaacgcagaagacgctaagctagatggtacggcatcaggtgaccgcacagtagtaaatgcaactaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtagtcagtaattgacgaggtagatttcatcctgcaatgaagtcattttattttcgtattatttactgtgtgggttaaagttcagtacgggctttcacccaccttgtaaaaaattacgaaaaatacaataaagtatttttaacaggttattattatgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtttactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaaccctgaaatttaatcaactggtaagcgttccgcctaccagttttataactatatgctttacccgccaatttacagtctatacgcaacccttttttacccctgtatatcaagcaaaccaagcaatgctaaaaaacaatttatatgataaactaaaatatactccgcaccatggcgatacaagggatttaataatatgacaaaagaaaatttgcaaaacactccacaaaatacgaccgtttcacttgtggaatcaaacaacaaccaaacttccccgcaaatgcttcaacaatcacccaaacctagcctattgcgcttggaacaacatatcgaaaaaaaagattatgagtttgcttgtcgtgaattaatggtgattctggaaaaaatggatgctaattttggaggcgttcacgatattgaatttgacgcacccgctcagctagcatatctacccgaaaaattactcatttattttgccactcgtctcgctaatgcaattacaacactcttttccgaccccgaattggcaatttctgaagaaggggcgttaaagatgattagcctgcaacgctggttgacgctgatttttgcctcttccccctacgttaacgcagaccatattctcaataaatataatatcaacccagattccgaaggtggctttcatttagcaacagacaactcttctattgctaaattctgtattttttacttacccgaatccaatgtcaatatgagtttagatgcgttatgggcagggaatcaacaactttgtgcttcattgtgttttgcgttgcaatcttcacgttttattggtaccgcatctgcgtttcataaaagagcggtagttttacagtggtttcctaaaaaactcgccgaaattgctaatttagatgaattgcctgcaaatatccttcatgatgtatatatgcactgcagttatgatttagcaaaaaacaagcacgatgttaagcgtccattaaacgaacttgtccgcaagcatatcctcacgcaaggatggcaagaccgctacctttacaccttaggtaaaaaggacggtaagcctgtgatgatggtactgcttgaacattttaattcgggacattcgatttatcgcacgcattcaacttcaatgattgctgctcgagaaaaattctatttagtcggcttaggccatgagggcgttgataaaataggtcgagaagtgtttgacgagttctttgaaatcagtagcaataatataatggagagactgttttttatccgtaaacagtgcgaaaccttccaacccgcagtgttctatatgccaagcattggcatggatattaccacgatttttgtgagcaacactcggcttgcccctattcaagctgtagccctgggtcatcctgccactacgcattctgaatttattgattatgtcatcgtagaagatgattatgtgggcagtgaagattgtttcagcgaaacccttttacgcttacccaaagatgccctaccttatgtaccttctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatgcattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgtcttgaactccgtcgttacatcatagaaaacaacggcttacaaaagctttttacaggcgaccctcgtccattgggcaaaatactgcttaagaaaacaaatgaatggaagcggaagcacttgagtaaaaaataacggttttttaaagtaaaagtgcggttaattttcaacgagttttaaaatctctcaaaaatcaaccgcacttttatatttataacgctcccgcgcgctcacagtttatctctttcttaaaatacccataaaattgtggcaatagttgggtaatcaaatttaattgctgatacggtaaactaaagacggcgcgttcttcggcagtcatgtcttgtttttccaattcttttaaatgtgtttcgatactttcttgctgttggttaaaaatagcttcgggtatttcttcaatgtgttctaaggtataaataattttctttgccacaggataaaaaccagataaaaactgtgcggtctgttgcaaatttttcattctgtctcgataagctcccagtgctgaaatatagcttaatagagaataattcagtttgagtaaatcaaaacctttttgtaaatatgccttgtatttcactggttcattattcatattggaaagtgttgtactcagtgcggctgcatattgatgtgcattgcgacgtgctatgcgatatttaagatcgtcgcttttaccaaattgcaattgactaataatatgcaataaatacaccgcatcactacgcaatgcttgatggctcactttatcaagttgcaaatatttccaatctggccataagtaagatacggcaaaccatgaaatcgcggcaccaagtaaagtatcaagtaaacgaggcatcaacgcagctgccgtatcaaatcccatgacatcaaaactgagcaatacttgtagtgtgatgaaaaaggtcgagaaactataattattactacggaagaaaaagaacaaagtacttgtgagcaccacaagaccctgttttaattctaaggttggatttaaataaggtaatagagaccctaccactacgcctaatatcgtgccaataatacgctgacgtaaacgtactttagttgcagaatagtttggctggcacacaaatacagtggtcaataaaatccaataaccaagattaaattggaaaaactcaacaattgcacagcacagaaataccacaatagataagcgtaccgcatgtcggaacaacggtgactcaaacgtaaaatggctaaaaatcaccgcacttatattttttaacccagtgatttgttccgtatgaatttgagctaattgttctgtatccgtcgtttcttgtgctaactggcgaagttgccagttaatgctttgtaaattatctaacaaggtttgaatatcaatcagttcatcttgatcattgagatgttgtgttcgatacagttcaaaggaatgcaaggtgcctaaaagcgcacgttcgacacgttcattaaaatgataaggtttattttcacgcaaactcgccgtgatttctttacaggattgtgcttgtagttctaacaaacgttgaatacggaaaatcaaatctgtattttttagtttttccgttatttgttgataatcaaaatgcgtagaattggcgcgttcgtgaatatcttgcgcagcaaaataataacgtaacattctctgggtacgaggatggcgatgttgccctctaatacggtaaaaaagtgcggtacgcacaatattaaatgccgtgacaacattcgcatttttcatcgcaaaattgaggtgttttttttcaatctcagccacttcgtcaggatcaaaaaaacaggatttagtatctaaatattcgcccaacgcacaaaacgctttagcgacactttcttgcacggggcgatttgggaaaaacaggtaaacaatcagagtcaccacgctatacagcaaggtaccgcataaaatcattacagggttaataaaccatacatttacctctggtatataagttaatgtggtgtaaagcgcaaccactaatgaaccgaaagcaatggtgctataacgctgccccacggcaccaatcatagtgaaaataaatgtcagcaccgtcattaacacaatatattggataggcttgccaatatgtaactgcacaataaaggaagaaatagaaaaggcaataagggtaaaaaatacgtttttcaatcgtccagttaaacggttatccaaatccaccaaaccacctgcaataatccctagaatcaaaggcattgattgcgaagaaatatcaaaaaaccatattcccactgccgcaatatttacggcaataaaaacaggaattgtagaaattactttagcatttaaccgaatattcatttcaaatccttatcaaaatagaaaagtgagcaacaaggctcactttttattgtataaagtgcggtcattatttatgggattttgcccagtttaaaaaacgtgtttgagtttctttatccgcttgttggaaccaatattgaagttgttgctctgcaacgttttcgccctgaacaaccactttgcctttattcgcttttgcattacctgctggcacagcaaccattgaattagcagaagttgttgcagtaaatttagaaactgatgccgctgcaccagacgcattatattcagcaagatcatttagcacattaccacttgggaataaaccttcttgttttaacacatccactttcgctgaaatagcattacctgattttgttttcacagtaatatttggcatttgattgaatttatcgccactatcaagattacgaatagctggtgcggaaataactaaatcttcagcattaccttgaaatgtcacaatcacaggattagattcaaaaagagattgattcgatcctgaaccaacaatttcatttaaacgcacaacaacctgatggctttgggtatcatctacagtaaatgtcttagcttttccgagagatttagaggctttttgaccatcaatcgctaaaaactcaaggttagatgaagtggaaaccattccagcaaaggttgccgtacttgtgcataatgtggcaagacctaatacaacagcgcgtaatttcataattgctcctttgatataaatgaaatactcgcttatgctatgccaaattagccaaaatgaaaataaaaagtaagaattaatttaaaattttttgttataaatagcacaaacaatcacaatgttttattatgttggcgatctacacactaaaccagtgtcgtgaaaatttaatccattaaatatcaacgggagtaacaatgttgaacgatattttaacaggctatggaatttttattctggaaattttaacaattttattactcattcttgctattgttggtttgattatttcttatcgccaacataacaagtctaaagtgggagaattagaaattaaagatttatcagaagaatttaatgaacaagttcgtttattacgtgattttaatctttctgaagaagaacaaaaacaacgcactaaagctgaaaaaaaagcagaaaaacaaaatgctaaaaaacgcaaagaaaaattgaaaaaaggcgatactttagaagatgaaaagaaagcttgcgtatatgtattagatttttgcggcgatatttcagcctcagaaacaaccgcacttcgtgaagaaatttcagcaattttaaatgtagcaaaaccagaagacgaagtattactacgtttagaaagcccaggcggtattgtgcataattatggatttgcagcctctcaattgtctcgcttaaaacaaaaaggcataaaattaactgttgccgtcgataaagtggctgcaagtggcggttatatgatggcttgcgttgccgataaaattgtatccgcaccttttgctgttattggttctattggcgttgtcgctcaaattccaaatgttcatcgactattgaaaaaacacgatgtcgatgtagatgtaatgactgcgggcgaatttaaacgtacagtgaccgtattgggtgagaacactgaaaaaggcaaacaaaaatttcaacaagaattggaagaaacacataaattattcaaacaatttgtctcacaaaatcgcccttgcctagatattgataaaatcgcaacaggcgaacattggtttggacaacaagccattgcattacaacttgtagatgaaatctcaacgagtgatgatttaattttggaaaaaatgaaagaaaaacaggtacttaatgttaaataccgtttaaaaaaatccctaataaaaaaattcggacgacaagctgaagaaagtgcaattaatatcattcatcgttatagtacaaaacagtctagagactttatgtactaaacatttatccacaaaaaaagaagtttttatttctatgtttacaagacaaatctttgtcattaagatactcgccgatctttaggggttttattatatttaattcataaatcaagttgagtattgttaatccaaatattacgcagctaatcgtttaaatgattagctgcgttttttatttcaataacaaaatcgcaacttaccatttccccttagcaaaattttctattgttcttgcttccataaatagggataataacgcccctattcaaaaggcaaaaaaataatgacgcactatattttattgattatcggcaccgcattaattaacaattttgtattggtaaaattcttaggactttgcccttttatgggtgtatccaaaaaaattgaaaccgctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacagagtctgtcgtttatggttttggtgcatctctcggtttttccttagtattggtactttttgccgcacttcgtgaacgtttagtcgccgctgatatacctgccacttttcgcggttcagccattgctttaattaccgcaggcttaatgtccctcgcttttatgggatttacaggacttgtaaaataataaaatgatttaccttttaatgataataactctgttaattttatttattgggttcactcagtatttttcaggaaaaagaaagaaataatgacctttttattcatcgtaattacgctactcgctttaattttcggtgcgattttgggctttgcatcaatcaagctcaaagtggaagctgatcctgtcgtagagaaaattgatgctattttaccgcaaagccaatgtgggcaatgtggttatcctggttgtaagccttatgctgaagccatttgcaatggcgatgaaatcacaaaatgtattccaggtggtcaaacaactatcgtaaaaattgccgaaattttaggggttgatgtaccaacaatggagggcatagaagaacctatcgagaaagttgcttttattgatgaaaatatgtgtatcggctgcacaaaatgtatccaagcctgtcccgttgatgccattattggtacaaataaagcaatgcacacgatcattcccgatctttgtacaggttgcgagctttgtgttgcgccctgcccgacagattgtattttaatgattcccgtgaaaaaaaatattgataattgggattggaaatttgatgcaaaactcgttattccagtaatgaatgtcgatggctctgaaaaaaaattggttgtgggggaataaatggcggacgtattatctcgtttcaattccggtaaattatgggatttcaaaggtggcattcatccaccagaaatgaaatctcaatctaattcacagccattacgccatctgcctctcggcacggatttttacattccactcaaacagcacctaggaacaacaggcaatcttttaataaaagagggcgattatgtcttaaaaggacaagccttaacaaaaggcgatggcttgcgtatgttgccagttcacgcgcccacttctggcacaattaaatcgattaaaccttatgttgccacgcatccttcaggtcttgatgaacccacaattcatttacaggcggatggtttagatcaatggatcgaacgtaatcctattgatgatttttcaacgctatcgccagaacaacttattcacaaaatctatcaagcaggtatagcaggtttaggcggtgcagtattcccaactgctgccaaaattcagtcagcagagcaaaaagtcaaactcttaattatcaatggtgcagaatgtgagccttatatcacttgtgatgatcgtcttatgcgtgaacgcgctgatgaaatcataaaaggcattcgtattttacgttatatattgcaccctgaaaaagttgtcattgccattgaagataacaaaccagaagccatatcggcaatccgcacagcactacagggagcaaatgatattagcattcgggttattccaacaaaatatccttcaggtgctaccaaacaactgatttatttgctcacagggatagaagtgccaagcggtgcacgttcatccagcattggcgtattaatgcaaaatgtgggaacaatgttcgcaataaaaagagcaattataaatgacgagcctttaattgagcgtgttgtcacccttactggaaataaaatcgctgaaaaaggcaattattgggtgcgtcttggcacacccatttcccaaatattgagcgatgcaggctatcaatttgacaagcattttcctatatttgcaggtgggccaatgatggggctagagcttccaaacctaaatgcacctgtgacaaaacttgtcaattgtttacttgcgccagattatcttgaatatgccgaacctgaagcagaacaggcttgtattcgttgttctagctgttctgatgcctgcccagtaaatttaatgccacaacaactttattggtttgcgcgcagtgaagatcacaaaaaatcggaagaatacgctctcaaagattgtattgaatgtggaatttgcgcatacgtatgcccaagccatattcctctaattcaatatttccgccaagaaaaagctaaaatctggcaaataaaagaaaaacaaaagaaatcagatgaagccaaaattcgctttgaagcaaaacaagcacggatggaacgtgaagaacaagagcgtaaagcacgttcacaacgtgcagcacaggctcgccgtgaagaattagcacaaactaaaggggaagatccagtcaaggcggcactcgaacgcttgaaagcgaaaaaagccaatgaaacagaaccaacgcagattaaaacactaacctcagaaaaaggagaagttttacctgataacacagatttaatggcacaacgtaaggcacgccgtttagctcgtcagcaagcagcatctcaagtcgaaaaccaagaacaacaaactcaaccaaccgatgcgaaaaaagcagcagtagccgccgccattgctcgagcaaaggcaaaaaaacttgcacaaacaaatagcaccagcgaagccatttcaaactctcaaaccgcagaaaatgaagtagaaaaaacaaaaagtgcggtagaaaaaacagaagaaaattcaactgcacttgaccctaaaaaagcagccgtagccgccgccattgcgcgcgcaaaagcaaaaaaacttgcgcaagcaaatagcaccagcgaagctatttcaaactctcaaaccgcagaaaatgaagtagaaaaacaaatagtgcggtagaaaaaacacaagaaaattcaaccgcacttgaccctaaaaaagcagccgtagccgccgccattgctcgggcaaaagcgaagaaactggcaaaaacacaagcaacattagaaaataatcaggaataaaataatgtttaaaatggttagctccccacatacccattcgggaaaactcacagcgcatattatgctttgggtcattttggcaatgatgcccgcttttttcacgcaaatttattattttggatttggcgtggtgcttcaatccgcattagccattggtacggcaatcattgctgaatttattgcaataaaattacgaggtaaaaaaccgctcaattatctttcagatttcagcgtagccctaactgcgttaattttggcaatggctattccaccttatgcaccttattggattatcatcattggaacactctgtgcagttttattaggtaaacaggtttatggggggttagggcaaaacccattcaatcccgcgatgattggctatgtaattcttctaatttcattcccattacaaatgacaacttggatgccaccaattaatttattacaggaaccaccgactttttcagatactttttcattaatattttcaggtttaaccacggatggatttaccctttcacaacttacacataacattgatggcatcacccaagcaacgcctttggatagcgcaaaaattttctataaaagtcacaatcaattaagtgatttttatgaattaattaaactgccgatttttatgggtaatggaaccgattttgctcaaggctggtggcaaatcaacgtggctttcttagcgggcggaattttccttattttaaaacgcattattcactggcaaattccagtggcgatgcttgtcacctttttctgtttagccactgcgaccgcttttactggtttcacgcatttaagtgcgattagccaactcgttagtggcgcaatgatgtttggtgcattttttattgcaacagatcctgtcacagcctccattacaccacgcggaaaaattatttttggcgcattagtggggttatttgtttatctcattcgttatcacggaaattatccagacggcgtggcattcgccattttattaagtaatatttgcgtcccacttatcgatcattacacacgtccgcgcgtatctggttatccaacaaaaggaagaaaataatgggtacagtaaaaatcacatcgcgttatggcatattgttaggctttattgccctactttgcacaataatttctacaggaattttcttcctaacaaaagataaaattgatgcggtaatcgcagcacaacagcgagaattacttctacaagttatcccacaagattatttcaacaataatttgctagaaagtgcggttattcctcaagataaaaattttgggggtatccaaaaaatttattttgcgaaaaaagatggaaatatttctgcctatgcctatgaaaccaccgcgcctgatggctattctggcgatattcgcttgcttgtgggattagatccgaaaggcgaagtgttaggcgtacgagtaatcgaacatcacgaaacaccaggcttaggcgataaaattgaacgccgaatttctaactggattttaggtttcacaaatcaatcgattaatgaacataatttaagcgaatgggcggtaaaaaaagatggcggaaaatttgatcaattttctggtgcaaccattacacctcgcgcagtggttaatcaaactaaacgctcagcattaatcatgctaaataatcaagccttgttacaacagctttcaacacaagtgaaataatatgacagatttaactgaaaaaaataccgcacttgaagaagaaaaaatagaaagtgcggttgaaaatcaacaaaaatccatctggaaagaaatttttgctcaaggaatttggaaaaataaccctgcggttgtccaacttctcgggctttgtccacttttagcggtgtctagcacagccaccaacgcgcttggtttgggtttagcaacaatgcttgtactcacttgcacaaatacggtcatttcccttttccgtcaatatattcctaaggaaatccgtattccaatctacgtgatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccattctcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatgtaaaaaaataaagcaaccaaatctttccttcccctgcttgcgggggaaggtgtcacgaagcgacggaagggggcttacagtcttctaaacagataattccaataaattaaataggctaatttctacaaaaatatgaacaaaacaaaaagaatcgaaatactcacaagattacgagagcaaaccccccacccgaccacagaattacagtataattcgccctttgaattattaattgcggtcattctatcggcacaagcaaccgataaaggcgtgaataaagcaacagaaaaactattccccgtggcaaacacgcctcaagcgattttagatttaggattagatggtttaaaaagctatattaaaactatcggtctttttaatagcaaagcagaaaatattatcaaaacttgccgtgatttaattgaaaagcacaacggtgaagtgcccgaaaatcgcgaagccttagaagcattagctggtgtgggtagaaaaacagccaatgttgtgctaaatacggcatttggtcatccaactattgcggtagatacccatattttccgtgtatgcaatcgcactaattttgcagcgggtaaagatgtggtaaaagtggaagaaaagctgcttaaagtcgtgcctgatgaatttaaagtggatgttcatcattggttaattttacacggtcgatacacttgtatcgcgcgtaaaccacgttgcggatcttgcattatcgaagatctttgtgaatataaagaaaaagttgaattttaattttgcggtaaaacagcctaattatttaccgcactttttattaaaaataggataaaaaatgacaacaaacaataaacagcgacaaacttggtcgagccgcctcacttatgtaatgacggtcgcaggcgcaacggtcggtttcggtgcaacttggcgtttcccttatcttgtgggtgaaaatggtggcggtgcttacgttctacttttctgtatcgcaatgattgtaatcggtatcccaatgattttagttgaaaacgtgataggtcgccgtttacgtgtaaattccattgatgcgttcggcgataaaattctcgacaaaggaaaaggcatttctaaatattggaaaatattaggttatatgggcttactcggcgcatttggcattatggcgtattatatggtgcttggtggttgggttatttcttatatcattagcctaatcagcggtacattagacatttcaacccccatcacaaaagacattgccaaaaatttctacgatcttcatatcggcaatagcccttatgaaattatattctacaccctcttatttgttatcgtgaattacattatcttggcaaaaggtatcattggtggaattgaacgttcagtaaaatatttaatgccattactatttatcttcttaattggaatggtaattcgcaacgtaacattaccgggcgcaatggaaggcattacattctatttaaaacctgatttcagcaaaattaccccacaattatttatcttcgttttagggcaagtcttcttcgcattaagccttggttttggtgtattaattaccctttccagttacttaaataaagaagaaaacttaatccatactgcagttattacaggtttcaccaatacaattattgctgtacttgctggctttatgattttcccctcacttttcacttttgggattgaaccaaacgcagggccaactttagtattccaaagtttacctatcgtattttctcacttatgggcaggtaaattctttgcgattatcttcttcggcttattattaattgctgcgctgactacttccatcacaatttatgaagtaatcattacagcattacaagaaaagctcagaatgcgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgctcttggctgtgctattttcgttggtttcgtgttaaaagatgaagccaaaaaagaactttcttcaacaaaatattcaactttcatcaaaatttggtttaactacgtgaaatttgttgtacccttgatcatcttagttatctttatcagcaacctgttctaaaaattaaaaatgcggtaaggcgactacatcaccgacaccgctttaatttgaacatagacatcttgcccaacagcaaaacgtagttcattttgcgcccatttactgatacttgcccaaatcttattcccttccactaatacggcaagatccactcgagaatcttgtatctcaatttgtgtaatcttgccacgtaaaatattacgaatgcttgtttgttctggcttttgcagtatgatagaaacatctgaactataaatacaaactagcactcgctcgcctacattcgcgggtacttgatgaatccaaagtgcttgttcgcctagcgaaagtgcggtcattttataaggtggattatgcaaatgaacaggcaaggcaagtacactgctctgttcgttttcccctttccaaggggcaaaaatagggctattccaaattttttctacgctgtcataggcttgcacaatgccgttttccatcaatacgacccgatcagctaaacgcaacagttcgtccaagctatgtgtaacatataaaatcgggatattaatttctttagaaagacgttccaaatattgcattagctcgcgtttgcggggaacatcaagggcagaaagtggttcgtccatcagtaaaatatcaggatcagtcagcagcgcacgccctattgccacacgttgtttctctccgccagaaagcgtaagcggataacgctttaataaatgagtaataccgagaagatcgacaatatagttaaaatcatcttgcgagacatgtttcatgccatagcgcaaattacctttcacagtgtagtgaggaaataaacgcgcatcttggaatacatagccaattttacgcaagtgggtcggcaatgattcttggctttccatatccactaaagtgcggtcatttaaacggatgaatccttcatctggttgtatcaatccactgactagattaatcagcgatgttttgcctgagccagacaaaccgaaaatggcggttacgccttgatctggcacttgtatattcgcttgcaaggcaagtttcccgagctgttttttcacattaatttgcaacatttccttgtcctaattttttctgcattcgcttgctcaaccattcagacagtaacaaagaaatcaatgaaagaatgatagcaaataaacataagcgagcagtttgttcttctgctgcgggtgtttgaataaaagaatacatcgcaaggggaatcgtttgagtttcgcctgcaatgttcgatacaaaggtaatggtcgcgccaaattcccctaatgatcgtgcaaaaccaagcacgagtccagctaaaaccccaggtaaagaaagcggcaaggttattgtaaaaaatacacgccaagcggaagcaccgagtgtttgcgccgcttgctccaatttaatatcaatattttctaaagaaagtcgaatcgcgcgaacaaccaatggaaaggccaccacggcagaggaaagcaccgcacctttccaactaaaaccaaaagataagccaaaccactgatataaatacttgccaatgaaaccattgcgccccattgctacaagtaatagataaccgataaccactggtggcaacactaaaggcaaatgaattacgccagtaatcagagatttgccatagaagtttttgcgcgctaagagccacgccacaaaaatggctaacggcaaactccaaagcatagaactgactgcaacactcaggcttaaattaattgctgagatttccattggcgtcagattgaaaaatgaaaaaaattgggtaagcaaaatgaatccttatctaaatagcctctctttaaatcccttgtttatgggaatatcccacattgatgagaggtaagatgctctataataacaaaagggcagaaatatccgcccttcatgactattaagattctatcttattttgcagagaaaccataccctacaagcactttcttcgcagcatctgattctaaatatttcaagaaatcgcgagaatccgcattatcatgaccttttacaatagaaacgggataaacaactggtttatggctatctgcagggaacactgcaaccgttttaacttgttggctaacttttgcatcagtgctgtacacaataccgtaaggtgcttctgcacgttcaactaaagctaatgcgccacgcacatctttagcacgcgctaaacgatcttgcactttatcccataaatttaatttggttaatgcttctgctgcgtattgaccagcaggtacgtgtgcaggatcgccaacagataaatagctatcttttaatgcattgatccattcaccttttgcaatatccacagaatttaccgcactttttgctggtgcgattaagactaaatcattgcccactaaaactttttctgtttcttttacggttaaatctttttcagaaagatatttcatccatttattgcttgcagatacaaaaatatccgctggcgcgccttcttcaacttgttttgctaaagttgaagaagaagcgaaagaaaacactacttcatttttcggattttgttttgcgtaatcttttgcaacttgttgtaaagcatctgtcattgaagcggctgcaaatacagtcactttagcggatgccgcaaaagaaaagcctaatcccgcgattaaaagtgcggttgaaattttagttaattttttcatgaataatctcctatgattaaacgttatttacttgattatatattgaaataaataacaatcatatagcaaaagaaaaattatttagtaaaatatataacgcttaggcttaccacttaggattacttagggacagcaaaatgaaaaacaccgaaattttactcacgattaaacttcaacaagcactttttatcgatccaaaacgagttcgtttactcaaagaaattcaacaatgcggttcgattaatcaagcagcgaaaaatgcaaaagtgagctataaaagtgcgtgggatcatttagaagccatgaataaaatcagccctcgcccattgctggaacgaaatacaggtggaaaaaatggcggaggcacggtgcttaccacttatgccgagcgtttgctccagctttatgatttattagaacgtacgcaagaacacgcgtttcatattctacaagatgaatccgtaccgttagatagtttactcacggcaaccgcacgtttttctttacaaagtagcgcacgcaatcaattttttgggcgagtggcacaacaacgaatcattgactctcgttgcgttgtggatgtgaatgtgcaaggattaccaacgccgttgcaagtttctattaccacaaaaagctcggctcgtttgaaactgattacggaaaaagaagtgatgctgatgttcaaggcaccttgggtaaaaatcagtgaacaaccattagtaaatcaaccgaatcagttctctgtaaatatcaaatcactcaatgaagaggaagccatccttcaatttgctgaaagcaacattgaattttgtgccacggtccaccagccaaatcaatggcaaatcgggcaacaggtttggattcacattgatcaagagcaaattatattagcgacgctgggataattcagagatataatacgtaaattcaatacttatatttattgttttctgaactaaaataacctcaaatcaaacaaaattttaaataaaatatttaatttcatcgtatttcctatttacgtaaaaaagtttgataaagttttttcaataacgaggttggcaataaacgagaaccaaaacgcaatgcaaaagtaaataatccagataacaaaccctgaattcccaaacggtatttcaatttgaacaaacgccattctgctttagcttgattgacgccacgacggcggcttaccatgccatttcctactcgagcataaactaaaatatctggcaaattcgccatatataaaccttgtgcgacaagtttgatccacaaataataatcttcttgaagatcttcatatccaccacaattaatgaccgcacttttttgatatgccaccgtcatatgattaaacggacaacgtttttgcgtgaatttaataatttcttgagcagaagttggcacattacgatatgccacaatatcatttacatttttaccaaattcagcaatttgtccgccaaaaatgatgctttcagggtgctgttcaataaacgctacttgcttttcaaaacgatcaggcacgcaaatatcatcggtatccatacggaaaacccagtcataagtacaatgcaataaaccttcattcaaggctttgcctaatcctcgattttgcggcaatttgactaattttaatggcaattttgtttcaaattctgtcacaacagattctaattctggcgttactacgccatcaaaaaccaatacaatttcatctgcttgacgagtttgtgcaacaagactttcaaaacactcccgcaagaattgaggattttccttaatatataaggacattaggactgaaaatttcattttattttcccaaccgttttaaattaatggctaattttggcgaaattaaaataaccaaagtaataataaattgcctaatgctttttgttttcttaaaaatatcaaaataatattttgccgctttacgcgataaattcatgatatggggataagccaaaatatagctcgcgttaatatcaaaattacgagcttgctccaccgttttcacataatgctcgcgaatataatcaatggctttttgcgtattagtggtatccgtagacacacttgagcgtttagtatggaaagtacagtaagttagtggttcattaattttataaggagtaaaacttggctcttgtaacagttttaacaagaaatcatagtcttccaaagaacgaagtgcggtggataatccacctatttttaaaaacatctcttttttaatcgcaaccattggcatgccaccaatcttattggctaacaaaatacgttctgtcgagatttcttggggttcaatcggttgagtcacataagtaaacccttcattgaccatttcacatttagcaggatgataaataaaattaatgtctggattttgctcaatcacttgtagtattttttcacatttttctggcataaaacgatcatcatcatcgagaaaaagcaaccaatcgccctttgatgtacgcgcaccaacattacgactttccgctgcaccttgattggtttcgttacgaatcactgtaactggaaaagaataactttgttcaacaactactctctctttggagcaatcatccacaataatcacttcaaaattactcgatgtttgttgagttaaactttctaataaagctggcacttctgcttttcgattataagaaggcacaataatgcttaacataattccttcctttaattagccaaatttttcttaatcgcaaagatttttttcaatggatatttcattaattttttaagtaaattattggataaagatccacgaacactttctaaattgcttatcaatacaggattttcaatgaccatgagagggcgaaccactttatttcttatattaaaattctgttcaaagagtaaaaaatcatccgctaaccaaaatggtttattttgggaaatttgctggataaatcttcttgcggctgatttttttataagatagcccaccgtgccagcaaaataacttttataagggaaagcgtaatttacattgcctgtttttttgcatagaaaagaaaaagttgtgggataattaatttctaaatcagtatcattgaaattattaatttttgactgtccaagcaatataatttcagcctcaagtttttctgataaaagtgcggttaaattttgctgaaaatctgagtggaataaagcatcgtcttcacagactagtgcatagctatcttcagcaatatcgttgtcttcaataattttttggtacacagaaaggtggcttaaagtacaaccgatctcgcccttagtgacattacgaaaataatgtgctttaaattgttcaatattaaaaatagaggctaattcatcccaatctttttgcatggtattaatggcagaaaaaatttggaaatcctcggtatttttttgagaaaagaataatttccgacgttgaatatctttatctaaagagatcaaatatttttttaacataaaattattccttataaaatccctttccattcttcaataattttctcaatgccataatcttcactcattaaacgagatttgtctgacatttgttgataaagttcaggattattgattaataaatctaaacctttaaccatttcttcaatattattttgttcacaaagaaaaccattttctttatgttcgactaattgctttacgccaggagaacaattaaaggcaacaataggtaagccaaatgccatcgcttcaataacgactaaaggcaacccttctgtttgtgaaggtaaacaataaattgaactgctttcataataaaaagcaacatcattagtacgaggaataaaattaactgaatcttcaatattcaatgctttagcaagattttttaaattttcttcttcctcgcctgaacccgctattttcaaattccaatctggatatttttttgccaaaacttgccaaacttttaataaataatcaaaacctttataagaaaataaatgacctacagataaaacagttttattttcccattttgctaatttattctttggcaaaagcgtatttggattagcaatactgattatattgttcgttttaaatttttcttgccacagcgttttttctgcttctgtcaatgtaactattttatcgcaagttgttacagctaaatatttaccgagcgtgcgaacgagacgattgcccgtaaaattaaaagaataatgctcccataaaatatgttttatatttaaattaaccaacgccaaagcagaaaaaagcataattgcaccatcaaccacaattaaggtatccagctgtaattctttaactaattctcttaattttttagtgatagaaaaataatcttttttcaatgaatatggcaatttattcattgggtaaatattaattttttcatcaacttggaaaaaaggcttgttaccgccaatgctaataaaagaaacatcatatccctgtttagcaagagcattaacaacattaatggaaactcgctccgttccacccgcactttcgatattcataataaagaaaccaatttttttcattttaaatttccttataaatctttaatccaaggtctggaaatgaatcgtaacagaattgccatcttggaatactcgttctaataaaacgaatttctacattaggatgacttaacaaattaaatgcaacagaactgaagaacgtataaataattattattttatttgataaatatttaaatacgtaatcttcaaaaattaattcagattcaacataatttaccccatcaactcgataatcttctgctggatgagggaaataataatcaaaagaaaattgttcttttaatttttttattaatgagatattttcctcttttgtatttaacaatggttgcccaataaaaaatgagacctcaccatctatctcgcaatctatttgattatcccataaagaaattggttcaatattagaaacaatatttttgtaattaggataaaccgtataatgtttttttatttttttaaataatttattcacactatatttatcgccaataaaagctttaatcagtttatatttaaatgtgtcaggctctctcaataaattaggatgtgggaaaatattatctgaaccatcatcaaaggtataaagctctttaaatgaaacatgactaagataagtttgtagccataatgaattaagattggcgagaaaaaccttatcaaaacctttgtgcgtaattttattcttaagctggcgcattaacttgagaaaatcgaaaccttttagatcttttcccgtatcaatattcatcgaatcactacaaacctccgctaatttactcgcatacaaggttctttttttatcccataccctaccaaacattacgccaaagaattgttcattaggatgtaattcaattatttttctcgcaattaatacttgcaatggtgtacaacaaagaatgagattcatagggttttactcactttagatgtcataaaataaagaataggaataatggaaagcgaaccaataattccagcataagggatatatttaatttctgtaaaagttaaagctacaaggcttgccacataaatgattgtagataaaacggaacattgggaaataagtttatttttcccataatagaaaagataattaactaaaatcaaataaggaatacttaatgtggtcgaaattaaaaataaaataaaataatatttcgttcccacaaattgactacctaaaatccaaactaacacatcctcaggaataatccacattattaaggcaggaataggtattagcaaaaaggaaaataacgcccatttatgtagctgttgaataactaatttcttttgttttaaggcttcataaaaatagggaataatcgctttattaagtgcttgaatagcaatagaaacaattaaagcaagttgagcccccatagcataaagccctaaatctgtttcactgaatttgtgataaataaaaatacggtctaactgcccttttaagaaaaaacttgcataatgtaaaataagcggtaatccaaatcctaaaatataaaatagtgcggattgataatgcttaaattgatattttttagatgtcgtactctttctgtaaagaaaataagaaaaaaaccaaacgactaaattactcaataaaattgccaaaattcttttttcaacaagattattttgataatactcaagcaatgcgaccgtaaatacagctcccgtaacagtaagtgaaaattgaataaaagcataagaccaagcctttttctggcattgtcttacacttagctgaacatttaagaaagattggaaaattgaggaaagtgcagcgtaaaataatatttcagactgagcaatccaacaacccattaaaataatactgccgattatcgtggtataagcatagccggtattcaccactaaatttaatgaacgttttccgtaaaaataaaaataacgggaaattgcgccttcttgagttaaagaaaccacaattaaaaataaacttaaaaaagtttgataataagaaagtgagccatacccttctacgcccaatttacgggataaataaggcaaaagtaaaaaaggaactaactttgacgataattccccaacaaggtaaatagcactatctttaaaaactttcataaatatcaccgcacttttgatgaattcgagcgttcgtttatcaaaaaataagggggcttattttaacaaaatcaacatagacaagctatgactaatcattataatgaaactgctctacatcaaggatcttatctatgttagaactcggaaaacttcttaccacacttatcgcaccacctcttaatacctttgtattactgattattgcagcgattatttattgtgttcatttcaaaaaattagccaaatttcttgcgattataagtttcacttggctttatatcatgagtgtgccttttactggtttattgctaacaaataatgatgattctccagcccttacgctagatgagtataaacaagctcaagccatcgtcatattaggcggtggatcttaccaaaccaaagagctgtatgcagaaacggcttctggtgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttagtgaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcgttaaatagcaatatggttttattaaaagagtggattggttattggaaagcccattatgtagaataatttgcttataaaactcgatgacttgttgtttgaaaagaaaattatatttgctcataaaaaaatctgcaccttagttagttgtttagtccaacttttggggtgcagatcaattcaaggcttttttattatatttcaacattttatctataagaaaaaccgaatcccatagagattcggctttaattatgttgtgtttgaaaattattctttatgtattatgacttacgctaattccgcacgtaattttttggttacatccaccatcacttttaattggtcgatggtttctgtccagccacgcgtttttaaaccgcagtctgggtttacccataagcgttcttttggaattacatttaatgctttacgtaataaatgttccacttccgccgccgttggtacacgagggctgtgaatatcgtaaacacctgggccaatatcatttggatatttgaaatctgcaaatgccgttaataattccatatctgaacgtgaagtttcgatggtaatcacgtctgcatctaatgccgcaatggcaggtaagatgtcgttaaactcggaataacacatgtgagtgtgaatttgcgtatcatcttgcacgcccattgagcttaaacggaatgcttcgcctgcccattgtaagtatgcgtcccaatctgcacgtttaagcggtaaaccttcacgaatggctggttcgtcaatttgaatgactttaatgcctgctgcttctaaatctaacacttcatcagataatgctacgccgatttgtttacatacggttgaacgtggaatatcgttacgcacgaatgaccattgtaaaatagtcacagggcctgtgagcattcctttcattacacggtttgtgaggctttgtgcatattgagaccagcgtactgtcattggctctgggcgagttacatcaccgtaaatcactggtggttttacacaacgtgaaccatagctttgtacccaaccaaatttagtgaatgcgaaaccatctaataattccccaaagtattccaccatgtcgttacgttctgcttcaccgtgaactaacacatctaaatctaattcttcttggcgacgtactacatattcgatctcttttttcattgccgcttcgtaatctgcaagagataactcgccttttttgaaacttgcacgtgcgtgacgaatttcagtagtttgtgggaatgaaccaatgtttgtagttggcagaagcggtaaatttaaccacgcattttgcttaacgatacgttctgcaaatggcgatttacgttgatccgcaccttttggcaagtttgctaaacgttctgccacttcagggcgatgaatttcttttgaggttgcacgtgcatctgctgccgcttggcttgcatctaatgctgcttgtacagacgctctgccattatttaacgcttgttttaatacgtttaattcttctactttttgtagcgtgaaagataaccagctgtaaagtgcggtatttttttcttttaattgtacttccacttctaaatcaaatggggtatgcaataatgaacagcttggtgcaatccataaacgctcacctaattttgcttttaatggctctaatacatctaacactttgtttaagtttgcacgccagatattacgaccttcaatcacaccagctgataacactttgctgtaatcttcaaatgccgcaagttgttctggtgcacgaactaaatctaaatgcaagcctgcaacaggtaaggcttttaataattcagcgtgttctgcaactgaaccaaaataagtggctaataataattttgcgttcactttgcttaattcagcgtaaacagatttataggcttcaacccattctgctggtaaatctaatgctaatgcaggttcatcaatttgaatccattctgccccttcagccactaatgcatttaaaatttcaacataaacaggcactaattgatttaataaatcgaaacggttaaatgcttcgcctttttctttacctaaccataagaatgttaatgggccaacaatcacaggtttgaagtttaagcctaaggcttttgcttcacggatttggtttacataatgtgctggattagctttgaaagcggtcgatttttggaactcaggcacaagatagtgatagttcgtatcaaaccatttggtcatttcaattgcgaattgatctttgttaccacgtgcaagttggaaatattgatcaagggttaaattttggctatcaaaaccaaaacgagcaggaattgcccctgttgccacttgtaaatctaaaatatgatcgtagaacgtgaaatcgcccactgcaacgaaatccgcattggcagccgcttgatgtttccagttttttcacgcaatgctttcgctaaatctaataaatcttgctctgctaattctttacgccaataacgttcttgtgcaaattttaattcacgttttgcccctacacgaggaaagcctaaaatatgtgatgttgtcataataactcccaatttaaagtaatttttttaatcatttagacggctaaacttctataccaatatagaatgcttgatcttcatttattatgcaaacttattattttcaggatttacattaaataaattcataatcaagcattcttttatctatcaaataacgatgaatcaattcagctaacttatttccttaaaattaatctcgcttacgacttaataaccaccaaatcattacaatgaaaagcaagctcgggatcaatgcaccaaaaatagcaggaataccgtaaactacactcgtttgtcctaaaatttcattaacaacataaaataagaatcctacacaaatcccagtaactatccttgcacctgcagtcacactgcgtagcgagccaaaaataaaagataaggctaataacatcattacgccaacggatacaggctggaaaattttacgccaaaacgtgagttcaaaacgactcacatcttgccctgtttcacgcagaaatgaaatgtaatgatataaacctgagatagataatgatgtcggacgcaaagaaaccgcacctaatttatctggcgtcaaactagtttcccaagtttctgataaatgattcgttgtgatgatttcatctttcataatcgttgaatgattaacttgacgcaatgtccatttagcttcatcttcagaataactcgcctggtttgcatgttttaattttattaaattatgctgttgatcaaaggtataaatataaatatcgtctaattttgtatcatccgtcacacgcctaacaaatacaaaatgatgaccatctttcgcccacacaccatttttaattgaaagtattgaaccaccagaaagagccttagcgcgcatatctcgtgcaaattgttctgtttgtggaattccccactccccaataatcattgtaaatactactaatggtaatgcagttttcattaccgctatacctattttaaagcgagaaaatccagctgattgcataataacaagttcgcttctgctagcaagattacctagtgcaattaatgccccaagcaatgctgccataggaaagaaagtttcaatatctttcggtatagttaaaccagtaaaaattaccgcttgccaaatatcataagtgcctttacctacactacgaaattgttcgacaaatttaataatcgccgacaatcccactaaagtcattaaagtagcaaaaatcgtgccaagaatactttttccaatataacgatcaagggtatttatcattttgccgatcctttcttactgaataaatagcgaaatttatacattatttcactgtcccagctattcaacaccacagcaagtaagaaaaatccgatattaacaagcggcattaaaagttcagcctctaattttcccgctgaacctgcagatttaaaagagctttgtaacaagaaataaattaaatagagtaaaagtgcgggtaaaattttggcaaatctaccttgtcgaggatttacgcgacttaatggtacagcaatcaatgccattaatggcactgccaaaattaaggtaatacgccaatgcaattcagctttcgcagaagaagaatctaaatcgataagttgagacaatgttaattctgctacttcatcattggtattttctgcggattgataacctaaataggcgtgatattcatcaaaatgcgtaatgcgaaaatctggcaaagcggaggttccttcaacccgttttgtatttttcaaatttaagacttgatcaccatttggcaacgcaattaattcccctttttcagctgttatcactgaaggttttgtttgtttttgaggtgtcatttgaaataaataaacattgcggatttgattatctttaatcttatcaataaataacacaacgttattattgttggtagaaataaactgacctgaagacagcacgccaacggttggattagcctttgcatcttccaccatattcacttgtttttgaattgcccaaggcgaaagccataatgcgttataagcggcaatacctgccgttaataaagacataatcagtgccactttaaccaaaatccgttgccccacaccgcacgcgcgcatcactgtgatttcactttcagcgtaaaggcgaccaaaagtcagtaaaatcgcaataaataaacatagtggcaacatcaactgcgccattgtcggcattcctaagcctaataaagagaaaaccaaatcagctggcacattcccatttgccgccgcacctaatacacgcacaaactgctgactaaaaaaaatcaatagcaaaattagtaaaattgcgatttggcttttgaaaacttcttttattaaatatcgaattaaaatcatcttatttcgtttgtttttctaaatctaaaacggaggaaaactggataaaatcggtcgcatatgataacttattttcgctgaattaaacagaaatttaaggacaacaaatgaaatatcaagcaaaaaataccgcactttctcaagccactgattgcattgttttaggcatctatgaaaataataaattttcaaaaagttttaatgaaatcgatcaattaacccaaggttatttaaacgatttagtgaaatcaggtgagctcactggcaaattagcccaaaccattttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatctttaatacggattgtaatcaagcacaacaagctatttctcacgccaatgccattagctcaggcataaaagcagcacgtgacatcgcaaatatgccaccaaatatttgtaatccagcttatcttgctgagcaagcaaaaaatttagcagaaaattctaccgcactttcattgaaagttgtggatgaagaagaaatggctaaacttggaatgaacgcttatcttgccgtctcaaaaggctctgaaaaccgtgcttatatgtctgttttaacattcaataatgcgccagataaaaacgccaaacccattgtacttgtaggcaaaggattaacctttgatgctggcggtatttcacttaaacccgccgcagatatggatgaaatgaaatatgatatgtgcggtgcagcctctgtcttcggcacaatgaaagccattgcacagttgaacttaccattaaacgttattggtgttttagcaggttgtgaaaatctgccagatggcaatgcttatcgcccaggcgatattcttaccactatgaatggtttaactgtagaagttcttaatactgatgcagaaggtcgattagtgctttgtgatgcacttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctggggtggcgcaattacagcgggtgcatttttgtctaacttcacgaaaaaatatcgctgggcacatttagacatcgcaggcactgcttggttacaaggcgcaaataaaggtgcaacaggtcgccctgtttcgctattaacccaatttttgattaatcaagttaaataaccacaaaactggcacacgttgcacctttaaatcgattactctgctagttcggtttgctcgtgtgccatcagttcctgacccacatcatcaagcaaacttagataacgttcatattgtttcaacatatcggcaatcaattcatcttgatccatatattgaacatcgtaaccgactcgtccatcaaaaaaataagtgtaaggctcgtaagtaacactatgctgaatgtgcggtaaattttcatcgttaattaattgctctgacacttctcgcccaacagatttaataccatacataaaatctcgcattgattctttatgaattaccaattccaaagctggctcttcttgttcaaataatgtgttgatttctacacttaaattatattttcctgttaattcttgacgtaattctcgcatagcgggtaacgccgtatttttaaggaaacgtaaaatatctttctcttgcgtttggttcatcatttgctctaaatgtgatttccatttatcgccgctccagaaaatactagttggattgactttagtagaaaaatattttttatccgcaattaagcctttccataaactaaaacacattaccaacatcaataaagcaaaaggcaaggcaacaattaatgtcattgtttgcaaattagcaagtccaccagattgcattagcacaattgcaacaactgacatcaaagtgccccacattatggcttgccacgcaggagaagctaaacttttatctcgagatgcaatgttatttaacacataaatacctgaatccgctgaagtgataaaaaacaatgaaatcactaataagctcacaaagcctgttattgttggtaaaggcagataatttaaaaatttaaataataaaatttctggggaagaaataaattcgccaagcccgcccgcagcaatgccatcatttagccatactgctgtattaccaaaaacagtaaaccataaaataccaaataaacttggaataactaatacgccaaaaataaattcacggatagttcgccctttagaaatacgcgcaataaataaacccacaaacggagcccaagaacaccaccaagcccaataaagcacagtccatccgctaaaccagctagtatgttcttgttcataagcataggttttaaaactgagttgcactaaattgctgaaataattaccaatattgtcgctaaatgcagataaaaggtataacgtagggcctgaaattaaaacaaaaagaagtaaacaaaatgctaaagttaagttaatttcacttaatattttcacgccttttccaataccagaaatagcagaaaacaccgctaaacacatcaccacaacaataacgccaacttgtaaggcaaagctgttctgacttatccaacctatttgttcaagccctgcaccaagctgtgatgaaccaaaacctaatgtagtaataatcccaaataatgtggcaagtaatgccataacatcaatcgcatcgccaattttgccattaatacgatcttttaataaaggataaaaacaagagcgcaacgctaaaggtaatttataacgaaacccaaaataagctaatgctaaagcaatggtgccatatactgcccacgcgtgaattccccagtggaacaaagtatgaagtaaagcctcttgttgtttatgttctgcagaacctactgtaatgtcagaaagataatgggttaatggttctgctacgccaaaaaacatcagcccaacccccattccagcggcaaataacatcgcaagccaagataagaaactaaattcaggttcttcttcatcttgccctagttttatattgccaagactacttactgataaaattaataaaaatcctaaaaacactgaaaaagtgagtacataaaaccaactaaaattagcaaaaataccacttttagcttgattcaataatgcttgagtttgctctggcgcaataaaaatcattgccatcagtaacaatataaaaaataacgtaacgccaattaccaaaggattaaatgacgttcgctttgtcataaattgagataaagacaaacttttccccttaacgattaaatgaatagattaaaaatagatttaataaacattgcctagaggcaaaaatgtgtaatggaaccactacaaaggacagcacatagaagtgcgattttgaaggaaacgttcagtaggaattgaaggattgtttccaaaaacttgtgtatattaacaaaatacagtcattatttcaaattagtgaaagctaaactaaaaaatgcggtaaaatttacaaaataatttaccgcacaaatatcatttattttaaagccatttctacaaggatattattgcttttaagccaattcttctcccctcttttacaacattttctaaccgcactttaaatccgtgtaattccgcaattcgcataacaatagaaagtcccaagccacttcccttttcattttgcccagctggacgataaaaacgctgtccaagttttttcaaatcttcaggttcaacgccaccaccattgtcctcaataataatctgtgaggatgaaatttttactgaaacgattgtatcttcaggacaatatttaatagcattgtcgagtaaatttctaagcatcaatgaaactaaaattgattgcccttgtttttgctttggttcagattctttctcaaaaaccaaggtaattttacgtttttctgccacaaaataacgctcagaaattaatgattgaacaatagcttcccaatcaagcagctgtagtgtttctaaggcttgcaaattatccaagcgggaaagcgttaataattgttcaatcaattgcgaagcccgatcaatgccttgcgttaaatgtaaaagtgcttgttctcgtaacgctacatcatcgccagctagttgcgcaacttcagtttgaatacgcaatgccgccaatggactacgcaattcgtgagctgcatcagaagtaaaacggcgttcgcgttgcaacatagctgaagtgcggtcaaaaaattgatttaaattttttactaagggtaaaatctcaacgggtagcccctccgtattcagcaatgacacatcgccagattttctcgtttgtacttcttggcttaaacgtttaatcggtcgaagttctttatgaatcaaccatcctaaaacaatgatcaaaataggcaaactggcaaaccaaatccacatttgccccaaaatcatttcttcaattaaatcttcacggtaatctaattcttgccctactgcgataactaattctccattagctgccatacgccaaaaaattcgccatttatcgtcatcatcataaatattcgcattataaaaccccgttttataattaaaaataaaatcttttccatttcgtccatcactgaataaaagtttcccagttttagaaaaaatagcaaaggctaaggcatcatcgtcataacttttttttaataccgactgtgaatttttatttagcgttgtgctagattccaacaaaatagtacttaaatctgaatttgcgagccgttcagcaaagagaacttgttgtgcatcaaaaactttattcacatcgtggcgaacttgccaccaagccacaagcgtagaacccagccaaacaaaaagtgcggttaaacaaagcacagaaataagacgcaacgtaaggcttctatttttcatttttcaacttgtcccaaagcatatccaacaccgtgtaccgtgcgaataaattgtttccccaatttttggcgtaaattataaatatgcacatccaatgcgccactgctaatttcctcatcccaactggataatttttcttcaatggatgagcgagacaatacgcaatctttattcagcataaataattcaagcaatttatattcacggcttgttaaagaaatgggttgattattcagccaaacagaacgttgattctgatctagcttaacaccagcctgttctatcacagaatgatgatatccataacgacgacgaataagggcttgtaaacgtgcggcgacttcagccaaagcaaaaggcttgcaaagataatcatctgcaccactttgtaaacctttaactcgttcatctaaagtatcacgagcagtcaaaattaatacgggaacatcttgatgattagatcgccattgttgcaatacatctaatccatcaagtttaggcaaggttaaatccaataccaccgcatcataagatgcagaggttaaagcagccattcctgtttttccatcggtaaaccaatccaccgcaaaaccaagtttagttaaaccaatctgcaacccattgccgattagattatcgtcttctatcaataaaattctcataaaaaattgaccgcactttatagacaaaaatagcgagctaacgcccgctatcttcaaagataattattctgctttttcaacgcgcaatacatcaagttctgctttctcaaaggcttcgttatccaattttccataaattttcactttatcctttgaatctacgtttaaaccattccaaacgcgttttttgatttcaatcttgatttgccctgtcccatcagtaaaccaaaattcatcgtcatcaatttgttgtgtaatattacccaccaaagtaatcattgaattatcagccgcagataaagcttgctttacgctaattgcagcaggcgctgtttgccgaaaaccaccttgactattattgccattaaaaccagcaaatgctgaagtggttgctaatgcgaagattgttgctaatgcaaattttttcataacgtttcctttttaagttagttaatttcaagcaccattgcttggatgtgtgtattaaaacaaataaatcttaataaaagattaagaggactatacttttttggtaagactttatcaaggcaattttgcgaccactgcatagccttcaattaagccgtccacttcataagaagcatttgcagtaataaaagcaacctcaccttgtttcaaagaaagtgcggtcgtttctgagcgtaaatttaactgccctttcattactaataaaatactcgcactttgtgcttttaaatgatgtgtttcgccacattcatattgaatattttgcaaatcgaaatcttttgctggcgtggcgtaagtaaatatgcgtgcgtcttgaggggctgttggaataattttaggctccacttcacggcaatcgacaattttaagcaattctggaatatcgacatatttaggcgttaaaccacctcgaattacattatctgaacaagccatcagttcaatattttgcccacgcaaataagcgtgtggaatgccagcatcttgggaaattccctcgccttttttgagatgtacaatattaaacaaatagaaacaaattaaacctgcatctaatttatctaaagaaatattcatcgcatcaatagtgtaaagcacccaataatctggattaattaaatcaagattgttagcctcataagctgcttgattctctaacagaatcggggaaaaccattggtacaatagcgtttgatctgcctacataatatcagcataaaaatcaggtaaatcttgttcctgcaatttttttgcaagcttctataatatccgatttatttttaaaaccatgcaacaaccagaaatcagataaagcaatcatcatttcaggtttatgattgttatctttataagtacgtgttgatgcttttaaatcaatgcctttcgcattttcttccgcaaaacctatttcagcttgcgtttttgttggatgaagttgaatggaaagaggttgggcgacatcaagaatttttaataaatacggtaattcatcagcaggaatattcagtaattctggaatatattgatgccctccccatacgtaattttggagtgagcctgtaagtttataaatcattatttatttctattttaactagcgtaaccgtgggtaagtatacccacggctagttatagtcgttcctctttgaggaatctcacactaccccaacggggtagccttaaaattagcctaggatatacctaccctaggcaatttgtcttcccctagattatttatttaaccgcaggtaagtatacccacggttagttatagtagctcctctttgaggaatctcacactaccccaacggggtagtattgagattaacctagggtatacctaccctaggcaatttgtcttcccctagattatttatttaaccgcaggtaactataataaataaaaaatccgcacaaaggcggacttttttttatcgtaaacaaattatttctttaaggctaatactactgattctccagccactacttcgcctgatttttttacgatacaagaaatttcatccatatttgaaattacgattggtgttaagacagattttgcttttgattctaataaaggaagatcaaattcaatcacggtatcaccacgcttaatagattgaccttcttgtgcaatacgagtaaagccttcgcctttcaactcaacagtatcaataccaaagtgtacaaataattctacgccttcttttgattccattgaaaaagcgtgattggtttcaaaaattttaccaatcacaccatccactggcgcaacgattttgttaccaataggacgaacagcaataccatcgccaacgattttttcagagaaaaccacatcaggaacatcttcaatattaacgatctcgccagagatcggtgcataaatttcaacttccacagatttgttttcttttgaaccaaataacttgtcaaataagcccattttaatctcctatccattcaagatggatgctattttaacgtaaaatcaaatacttttgtttaatttaatgaattttccagcaaaaattcttcaattaattgatcaatttctgcagcggtcggtttttgtaatgcggcatcagcaagcgcttttgcatcttggaaatttacattacggattaattttttaatgcgaggtacagaaatcgcactcatgctaaattcatctaatcccataccaagtaacaataaagtcgcgcgttcatcccctgctaattccccacacattcccgtccattttccttctgtgtgagaggcatcaatcacttgtttaattaaaccaagcacagaagggtgcattggattataaagatgggaaataaactcattaccgcgatctacagccaaagtatattgagttaaatcattagttccgatactaaagaaatctacttcttttgctaaaaattttgcatttaccgccgcagagggagtttcaaccatgacacccacttgtatgttattatcaaaaactctcccttcttcacgtaattccgcctttaatgtttcaataaccgcttttaattctcgaatttcttctaccgaaataatcatcgggaacatcactgccaatttaccaaaagctgaagcacgcaataccgcacgtaattgtgcatttaaaatttcacgacgatctaacgcaatgcgaattgcacgccatcccaagaatggattcatttcttttggtaaatctaaatatgaaagctctttatcgccgccaatatccatcgtacgaagcacagttaagcgtccgttcattgcttctaccacttgtttataggcaataaattgttcttcttctgtgggaagctgttcacgatccataaataaaaattcagttcggtatagcccaatcccttccgctccattacgttctgcgccgtcacaatcacgaatcgtcccgatattcgcgacgatatcaaccttatgtccatccaatgtaatagctggaagatcttttaatttagctaactctgctttttcctcagaaattttcgcttcaagtgcttttaattcatcaatttgagatgccgttggattaatataaacttgattatttatcgcatctaaaattaagtaatcgcccgtattgactaatttagtcactttatttgtgccgacaatcgctggcaattctaaagaacgtgccataatcgaagtatgggaagttctgccaccaatatcagtgacaacccctaatactttttcgagattaagttgggcggtttctgagggagtcagatcataagcaacaagaatagattcttcctgaatatcgccaagatcaacaatgtgcatgcccaaaatatttttaactaaacggttagcaatatcccgaatatcgcctgcacgttctttcaaatattcatcatcaatttcagataacattgtcacttgttgatctaaaattttactcgctgcaacccctgcattcactttatttgaacgaagataatcaagaatttcttcttctaattcttcatcctcaagaatcatcaagtgaccttcaaagattgcggctttttcctcgcctaaagaaattaatgcacgttctctaattgaattaagttgttctaccgccgcagcacgcccttcataaaatcgagcaacttcttcatcaatttgatcatctgtaattttttgcgtatcaagaacaatcttttcttctttaagaacaagtgccttaccaaaggcaatacctggggatgcgagaatgccagaaatcatagataccttccgaaacaattaacaaagtaataaataaacaatagccataaaatttcacaattttatggctaagtaagaattattctaaagtaggaattaacgcaactaaatgttcaactgcctgttgctcgtcttctccatcagcagaaatggtaagtattgttccctgcgttaaaactaatgtttgcaacttaaataagctctttgcacttgcacttttcccccctgaggttactgtaatttcagaagaaaatgctttcgcttctttcacaaattgtgcagcagggcgcgtgtgtaaaccgtttggtgcaataatttccacatcttttgaatacataatgctacctcgactaatcaataattaaaaatataaaaccagaaaattgccctagtatcctttttcaaaacaaaataatcaagaataaacactaaaaagcctgaattaaatcataaaaataagctaaatagtttatttattattcacaatctcaatcgttaaactaatgaaaaatgacgttgtgattttgtttcacttaaactttcaattaatcgatgatagctatcataacgaacaggcgaaattttgccttgctcaacggcttcacgcaacgcacatccggggtcgctcaaatgtttacaatcacggaatttacaggtgcccaaaacatattgaaattctcgatagccttttgtgatttgctctgcatctaaatgccaaaggccaaattctctaattccgggcgaatcaattaaattaccgccttgtggcaaatggtaaagacgtgacgatgtcgtggtatgctgccctaagcctgatgtttcgctcacatcccctacttgagcgtttacgctaggcaaaatatgattaattaaactcgatttaccaacaccagattgcccaacaaaaatcgccgtgccttgtgccaaaagtgcggtcaatttttccatattttcaccgctctttgctgaaatcattaaaatttcatagccaatatcttggtaaattttaagttggtcttcaatttcttgacgctgttcttgtgccaataaatccactttattcaaaacaatgagaggcgtgattcccgcaatttcacacacaacaagataacgatcgataatatttaaggaaagcgttggcaacaccgctgatacaataataatacgatcaatattcgccgcaataggtttcaaaccatcataataatcagggcgggaaatttcattttctcggggatggatcgcctcaatcacgccactcacaccttgtaattgttcattgcctttacgccaaacaactttatctcccaccaccaaactcgacaaggtacgacgcaaattacaacgataaatttcgccttgttcattttcgacatctgcgtgaatagaataacgtgtgaccacaacgccttcttgtgattcgccaagcatttcatctgaccattcaatgtcttttttcttatggcgatgtaatgttttcgcattattcgattgaattcttctagtttggttttgagttaatttacgtttagccataaaagtgcggtcgttttttcccttgtttttggtaaaatgaaaaaaatttttgcataggatacctgatattatgccattcgataaacaaaatcttatttggattgatttagaaatgaccggtttagatccggaaaaagaacgtattattgaaattgcgactattgtgacagataaaaatttaaatattttggcagagggcccagtattagcggttcatcagtctgatgaattactcaataaaatgaatgattggtgccaaaaaacgcatagtgaaaacggcttaattgaacgcgtaaaagccagcaaacttaccgaacgagcagcagaattacaaaccttagactttttaaaaaagtgggttcccaaaggtgcatcgccaatttgcggtaacagcattgcccaagataaacgcttcttagtgaaatatatgccagatttagccgattattttcattatcgccatttagacgtgagcacattaaaagaacttgctgcacgttggaaacctgaaattttagaaggctttaaaaaagagaatacgcatttagcgctagatgacattcgagaatccattaaagagctggcttattatcgcgaacacttcatgaaattagattgacgaaaacttcaacaaaaaatttctttttatgaaattgcccttgcaagccctaaaaatatttgtataattcgggctcattcactgatgtgaactgcgggaatagctcagttggtagagcacaaccttgccaaggttggggtcgcgagttcgagcctcgtttcccgctccaatttcacattataaaagcattattgcgggaatagctcagttggtagagcacgaccttgccaaggtcggggtcgcgagttcgagcctcgtttcccgctccaaatttcaatccttagccaaaaggctggggattttttctatctacaaaaatagatcatcaaaatgttaaaaagtgcggtgaattttctcaaaaaataaaggcttgtgatttaataacacaagcctttatttttatgctttcttcaaccgtttggcacgacgtttcattcttcttacccaacgggtaattcgccatgcatgcgtaattgaatagacataaaggaaaaataaaatgaaaaagccaacaaacatcgcccattcattcacataataaacttcccctaaaataccgatagttgcacaaactgcagaaacaaacgtaatcaataaaaaggcttgtcttgatgttaaacccgctcttaccattaaatgatgaacatgtaaacgatctggacggaatgggcttttacctttacgtacacggcgataaataatcgcaaccatatcaatcaaaggaatcgcaataatccaaagtgcggttactggattcataggatgcccttttccttgcgtacttaataacaaaatccaaataatggtaaagccaattaatgtactcccggcatcccccataaacaccttatattttggtccaaatggaatccctagattgagcatcaaataaggtaaaatcgatacgattaaagcaaaactccaatgcgccatatccatttgcccatctcgatacattaaaataccaatcgccgcaaaagaaacacaagagagtcccccaagcaatccatcaataccatcaatcatattaaaggcattaataatcgcaatagtggcaaagacggtaataatcaaaccaattgaaccaagcgttaattggaaaggccctaaaatttgaccaagatgatcaagataaatattcccaagatcgatcattaaaatcgccaatattgcttgaatgcctgctcttaaaaaagggctaatatcaaagcgatcatctaaaatcccaatcgccaataaaacaaaaatactgaacaaataaagatacggtaatcgaagttgatcccattccatcagataatagcaaagattaccaacaaaaagcgatacgccaccgattagtggaattgtgccttgatgacgtttacgatagtttggtttatcgactaatccaatccaattggcaagtggtcgcatcacaatcaatgttaaaaacgcgccaagaaaagtaacaaaaatactcagcatagtgtgaccctaaaattttttgtaaaggataacataaggcaaatttacctagaaatatatttttataaaaaggactatccaatatttcgatacagcacgttacgtaatatttctctttgttgagaatccagagcttgcccaaattggttcgtcaaaataaaaaaatcctcggctttttcgcctacggtggtaattttcgcatttaataaatttagatttaactcagtaaaaatctggctcacttgggctaataaccctgctttatccaaggcaaccagttccatttgagtatgttcttttttgttttcctgtaaaaaacgcacgtcggtttgtacagtaaaatgttgaagctggcgattaggcacaatagaaagtgcgggcaatttttcactttgaagggctaatgttagggcttgctctaattctcggcgacgatcaaattcaaccaattctccgttaagttctgtgatgataaagctatcaaaaacataaccatcttgtgtcgtaataatctgtgcatcgtggatactgaatttttttgcgccaatggtactcaccactttattaaataagtgcggttggtcttggcaataaataaacacttctgtgccgccaagtgaaaagcgattactaattttcactaataatgcctcaacgaaatccaccagcaaacttgtatgccacgcaatttgttttggcgtattacgcacaaaataatcttctggacaacgagcccataattgctcaatcgaaattggcgtaatatcagaataatcccgcattaaaatttgttgtgcaagttttcggttttctgccgatttttctgaataatcaagcaattctttcatgccttgtgaaaattgccgtcctgtaaattcatataaagaggcaaaaagcgaacgtttccagctattccataaattaccattggttgcacaaatatccgccaccgttaaacaggtcagataatctaatcgaacttgattttgcacggcttccgcaaaattcatgacgacttcaggatcatgaatatcacggcgttgcgccgtaattgacatcagcaaatgggattttacgagccaagcaagggtatcaatttctcgacgatctaaaccatgtaattgtgcaaagtctgcaatatccacagcaccaagttctgcgtgatcaccacctcgcccttttgcaatatcgtggaacaacgccgcaatataaagcaaagtgcggtcagaaagttggctaaaaattcgatgagcaatgggatgttcttgcgcactttcctgtgacagaaaactttccaatttcaacatcacgcgcaatgtatgctcatccaccgtataaatgtggaacaaatcaaattgcattaagccctcaatggcttgccattgcggaagatacgcagttaatacaccatattggtgcatcggcataaacgcacgtttaattgcattaggttgattaaataaacgtagaaatttttcccgagcggcaggaatttcgcataatttttgtgataattgatctaaggaaatttgtaattgacgcaaagtatcagaatgaatattggcatgttcgtactgcgttaaataaaagaatagatctaaaattcgcgctggtttttcttgaaaaacaaagctattacgcaaacataagcattggttaatcagttgaaaatcatcgtctaattggtcaattacagtatcctgatttgatggaagcacattttctcgataatgctgaatcagtaaattactaatcagcgaaattcggtgcaatgcttggaaaaaacatttcatcattttttccacagctggattgccttcccctcggaaacccaataattcactgactttaatttgacgatcaaacaacagacgattatcgtaacgtttcaaaatcaaatgcaaagcgaaccgcactttaaataaaaatgcacgactttcttgtagttgctgatattcttgaggataaataaaaccactttgtaaaatagcctcaagggtcaaagccccagaatggcgcaacgccacccaatacaacaaatgcaaatcacgcaagcctccagggctgtacttaatatctggctcaaggttataagccgtattgtgataacgctgataacgttctatttgctcttgcactttggcattaaaaaaatcttctttcgaccaaaaatctgcacgttttaccaattcatttaatgcatcaaagtgcggtcgatttccagcaagaaatcttgcttctaataaattggtggcaatcgtaatatcttgtttcccttccgattcgcattgttctaaggttcgaacactatttcccacctcaaaaccgcaatcccataaaaactggataaattgagtaatcttttcttcaatctcagggcttggggtttgctcgactaaaatcaaaaaatctaaatccgacaaaggaaacatctcacgccgtccataaccgcccaccgcaattaaagcaatccccagttgttcacttaattctatttcctgccaaagttgaatcaataaggcatcataaaaatcacagcgattttcaataagctcaaaaatggaataacgagaaaaattctcgagctcaaattgcttgagattttctcgttcaattttgaccgcacttggcgttaaaggagaagatagtgtcggagaaaacagcatatgaattgccttttgttagatcgaagtcgttttattataaagaaaaacaaaaagggcgtatatctacgcccttatcttataattttatgtcaattacacattcaccataatccgcgaaattcgaccttctgcaatttcttcatcgcggatagtcattacttcacaaccagtttccgtgacaacaagttgatgttcgtattgtgctgaatggctgcgatctttggtttttactgtccaaccatctcccattacgcgcacttcttttttgcctgcgttaatcattggctcaatagtaaacaccattccgggttttaaaatcacgccgccatcatcggcgtaataatgcaatacttgaggttcgcagtgaaattccgtaccaacgccgtgtccgcaatattcacgcacaacgctgaaagtctggctttccgtatatttttgcacggctttacctatttcatttaaacgaatatcgggttttacagtgcgtatcccaacatataatgcttcttgtgccgcttccactaattttttactacgaatattcgtttcgccacccacgatatacatttttgagttatcgccaaaataaccgtctttaatcacggtaacatcaatattcacaatatcgccattttttaacactttatcgtcacttggaataccgtgacaaacgacttcgttaatggaaatacaggtcgcctttgggaaaccgtgataattcaaacacgcagggataaccttttgttcatttaccatatattcatggcaaatgcgatcaagttcgcctgtggttacgcctgcttttacgtaaggttcaatcattaccagcacatcggaagccaatttgcatgcctcacgtaactttacaatttctttttcagttctaattggaatagccatttttatctcacttttttgaaaaaactttgcgagattatagcacgatttctaggaaaaaactggattgcacttgaatggagtaaagggttattagataatggcgggattgaaattttaggaaagtaggaaatagttatgatagatgatatggcggtgccactgacatttactgatgcagcggcaaataaagtaaaaagtttaatcagcgaagaagaaaatactaatttgaaattacgcgtgtatatcacagggggtggttgcagcggtttccaatatggttttacctttgatgaaaaagtcaatgacggcgatttaaccattgaaaaatcaggggttcaacttgtgattgacccgatgagcttacaatatttaatcggcggtacagtcgattatactgagggtttagagggttcacgttttactgtaaataatccaaatgctaccagcacttgtggctgtggttcatcctttagtatctaagatggattttcaatttacacattatcaaggcaatgtatccgtcaaatgttcgatggaacacattgcccttgctaactggttcaacacagaagtgcggtcaaattcagacaagattttaaccgcactttctactgcaaaatcacttattgaaaatcaagaaaaagtcttagtcggtgcggaatatacgttatttttaaatgctgatgaagtaatggtgcgcgccaacaatctcgccattgaatcagatgaaattttagaacaagatttccattattatgatgaagaaagccttgctttttgcggtacgcaagattttattcattttctccaatcttatgttgattttattgcttaactcactatgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgcttagaaagtgtgaaaattgccgataatctcgcttttgatgaagtcattcaaattttattagataacgaatatcgccaaactacaatggttgccgcacctggcgatttcaaattagaagatgatagcattgtaatacttcgccgtgcttttcctttccccgataaagcagagcctcagcgagttttgcgcttgcgttttagccataataagttatctcgcattgaagatttagtcacagtcaaaactgttgatgaatttcgtcttgcaccaaagttgattgcgatgttgcaatcagacaacgaagatcgtttagctattcctttacaaaattatccccgtttattaattgatacattaattttaacggaagatcgccgcttttatgaacataatggcattaatccagtggggattttacgcgcattaattgcgaatattcgtgcaggtcaaacggtacagggcggaagtacgctcactcaacaattagtcaaaaatttatttttatcgcgcgaacgcaccattacacgtaaagccaacgaagccttgatgtcattggttttagattggcgttacgataaaaatcgcattctcgaaacctatcttaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccttggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtgaactgggcgaacacaaaatatccagtttacttggcgcacgtattttttccacaatggatttaaaacaacaagctcaagcagaaaatgcagtggtcaataccgtttcgcaattacaactgaaaatgaaaaatccccatttagagggagcgatgattataacggattatcgcacaggcgaaattcgtgcagtagttggcggtttacaaacgcaatatgcaggctttaatcgtgcattaatggcaaaacgtcagattggttctttagtaaaaccttctatttatttgaccgcactttctaacccagaacagttccgtttgaataccccaattaataaccaaccaataacaattaatgtcaaaggtagcccgccgtggcagccacgcaactatgacaaaaaatatagtgattcagtaatgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttatagcatttcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctgtttggctaaataatggtcagaatttctgtggcgaaacatcatctccctctctcacgccaacaactgaaacagaaacaccaccacaagaaagcctgtgggacgtattggataatcccaatccacccgctcaataattaagccgtaggatttactaaatttccaataataaacattttccccctatacttcccctaacatttcagaggatttttatttctttttaaaaaatagcaaacgtttgctttatttgatttaaaagtgcggtacaatacgcaccagtttttactttcatacaggtgcaaaacaatgacacaacaactccccattttaagtctaaaaaaaatatattcaggcaaagtacgcgatctctatgaaatcgatgataaacgcatgctaatggttgcttctgaccgcttatctgcctttgatgttattttagatgatcccattccacgaaaaggcgaaatcctaactcaaatttccaatttttggtttaataaacttgctcacattatgcccaatcatttcactggcgacagcgtttatgatgtgttaccaaaagaagaagcggatttaatcagaaatcgcaccgtcgtgtgtaaacgtttgaatcccattaaaattgaatctatcgtacgtggttatttaactggcagtggtttaaaagattacaaacaaactggcacgatttgcggattaaaattgcctgaaggcttggtggaagcgagtaaattacccgaagctattttcacgccatcaagcaaagaagaagttggcaaccacgatataaatattagctatgcagaatgcgaaaaacttatcggagctgatttagccgcacaagtaaaagaaaaagctatcgcactttataccgtggctgcagaatatgcactcactaaagggattattatttgtgacacaaaatttgaatttggtttagatgaaaatggcacgctcactttaatggacgaagtattaacgccagattctagccgtttttggtctgtggatacttaccaagcaggaacaaatcccccatcattcgataaacaatttgtgcgcgattggttagaaaatagcggctggaataaacaagctcccgcaccaaaagtgccagaaaatattattcagaaaaccgttgataaatatcaagaagcactggatttattaacaaaatgaaaattaggattttttatgcacaaagctaaataaagatttttgcttttaatgcacaaaacactagacaaagaggaaaagtgcggttatactctatcgaatttttattcacaaaaatcgattatttattcaattctaattattagtaaggaaaatatatgtcaaatactattctacagaatttacctaaaggacaaaaagtagggatcgctttctctggtggtttagacactagtgcagcattactttggatgcgtcaaaaaggcgcagtgccttatgcctacaccgctaatttagggcaacccgatgaagatgattacaatgcaatccctaaaaaagccatggcgtatggtgctgaaaatgctcgattaattgattgccgctctcaacttgctcatgaaggcattgccgcaattcaatgtggtgcattccatatttctacaggcggcattccttacttcaatacaacgcctcttggtcgcgccgtaacaggcacaatgcttgtagcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtgcctgtggcattaaatggcaaacattttgataatgctgttgatcttattctagaagccaatcgtattggtgggcgtcacggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccagttgatcgtatcggtcaattaacaatgcgtaatttagatgtatcagacacccgaggtaaacttggcatctatgcacaaacaggtttattaagcgcaattaaagattccgtattgccacaattaggcaaaaaataaataataaaatctgcatttcaatgactgatatttaacatcatgaaatgcagatcctttcacaaaatattagttagctaaaaaaactagaaatataagaaataatcgtttttccacttaatattgccataataatcacaacaaaccagcctgaaaaagctaaaaaaacagggtgtttataagtgccaacaatatcacttctgtaagcagctaacaaaattaatgccaatgcaatcggcaatattaagccatttaatgttcccacaaagactaataccgcagcaggctttcccacagtgactaaaacaacagtagaaatcacaataaaagcaataatccaacgattacgattgcgttcaatggttggacaaagggtcgttaagaaagaaactgaagtataagccgcaccaataacagatgtgacagacgctgcccaaataaccactccaaataacacttgaccaaaattgcctgctacatattcaaaaggcgtttcagctggatttttaggattaagagacacaccttttgacaccacgccaagcaccgcaagaaataatacaacacgcattgttgaagcaattaaaatggctgatacagaactacggctcacttcagccattgctttttcgccttgaatgcccgcatctaataaacgatgcgcgcctgcaaaagtaatataaccgcctacggttccccccactaatgtaacaatagcaataggatcaattttttctggaataaaggaatgatacgctgcttcagccacaggtggttcagttttaaacattacataaaatgtgagcgcaaccataataaagcccattaattgcgcaaaacgatccattaataagcctgcttctttacgcaaaaaaatcaaaatagcaataataccactaatcactgcgcccatttctggtgctataccaaaaatagaatttaaaccaagccccgcgccgccaacattgccaatgttaaaagccagcccgcccatcacaatcagcgcagcaagaaaataccctgctttcggaaaaaccgcattagaaatatcttgcgcgcgtttgccagacacaataacaattcgccaaatattaagttgagccccaatatctaacaaaattgataataaaataacaaagccaaaactcgctaataaagtatttgtaaaggttgcggtttgagttaaaaatccagggcctatggcggatgtcgccattaagaaagctgcccctaaaaccgcatttcgtctgtgagtaattgatgccataaagcacctccattgttaagttgatgttatgtgtttattcggcttatgccgttattttgatatgatttttttctaattcttccacaatgcgtttagcaaattgtaaagaatgttgattatcgccgtgtaagcaaatactttctgcttttacaggcacaaggcttccatcaatggcattgacttgcccctttgttaccatttgtaacacttgttgaatggcttccttatcagattccaccattgcatttggttgagaacgaggcaccaaactcccatcaggcatataatgtcgatcggcaaaaacttcagaaatcgtttgcaatttttcttcctctgcgatgcgcaacattaaactgcctgctaaccccattaatttcaaattcggatcaaattgataaacggtttgtgcaattacacgcgctattttttcatcttttgctgcttggttatataacgcaccgtgaggtttaacataactaattaccgccccctcgccatcacaaatcgcttttaatgcccccaattgataacgcaaatgtgcgattaattcctgtgaagacaacgccattgccgtacgaccaaaattttcgcgatcaggaaaactaggatgtgcaccaatacgcaccttattttctttcgcaaatttgaccgcactttgcatttcctttgcgcccccagcgtgtaagccacaagcaatatttgcagaagaaagcaactgcaataaactttcatcaaaaggaaaaccctctgcaatatctgcatttaaatcaatttttttcatcaacaattctcctaatttgatcaaggtatatttcatttttacggcgtaatttagcagcctcttgtaagctaaccgcttcaaatttaatcgttgaacctaaacgtacctgtgccaaagccccaagatcagcatcaatcacattagcgattttaggataaccgcctgtggtttgcgcatcagccatcaaaataataggctgaccacttggtggaacttgcacactaccaaactgaatggcgtgagatagcatttccaacggctgctttaattctaatgtctgaccttgaaaacgataacccatacgatcactgttactttgcaacgtccattcatttcgccaccaataatattgggattttcgtttaaacgcctgatattcagaagatggcaaagcacgaataacatctcgaagcggaatcggtgcaataccaatttcgctacgcaaaatatgatcatttgccgtttgtagttgatcgcccgcctgcaaacaacgcccctcaatgccccctatttccgctctcaaatccgtgctgcaagaattcaatgcttgaggcaaaacaaaaccaccttgaacacataaataaccatacattccaatttttgcacgtgtcatttttaatatttgacctgctcgcacttgataacgccaataagcaaaaacgggcttatcatctaacatcatttcataaaaagcaccagtcacacaaaaattcatatcttgctgaaattgcaatgtaataccgcctaaaggcacttcaatggcaggaacattctctgcattgcccaataaaatattgcctgcgcgtaatgctaatttatccattgccccacaatggctaatgccaaatcggcgtaaaccaaaacgccctaaatcttgaatggtggcgcgggatttcacatcaagaatatcaatcatagttcaatcccatccacaataaatttcacagtatcgccagcttgtaataaggttggttgtgcttgatttttatcaaaaagtgcttgtttagtataaccgatcaactgccacccacctggcgaagaaaaaggataaatccccgtttgcgcacccccaataccaacagaaccagcaggaacaaccgttcttggcgtggcgcgacgcggcgtgtgtaaattttcaggtaaaccacccaaataaggaaagcccgcttggaagccaatcatatacacagtataaataggctcactgtgcatctgaataatccgctttggtgttgtctgatgaaatttcgctacatcagataaatcctgacctcgctctcccccataaataacaggaatttcaatatgacgcccttgaaaatccgatactttcaactcagcccaaagttgttctaaacgttgcacaagcggcttaaaatccacgaaaaaatcggtaaaaaccgtaagattattcattcccaagacaacttctacaatatcttgttctgattgcaattgacgagcaaacgcccataattggcgttgttgttgaatggaagctgggggtggcaaagagcaaaccaccgccgattcactgatcggaacgatattcataagataccctttatatgatgttatgtgatttgttatttttttgttacagctcttttaaaggatatttataggttttgtcaagtctttattttttatttaaaataaggtttaggtttgtttatcttttatttctttttagcaagaaaaaagattaatcttgacccattttaggtgttttttgttgaaaagtgcggtaaaaattaaaagaaaaacctgctttctggcattgaaagcaggttttaggcaaaagggaacggcaatttattgaagtatttcgcccacaatactgcgagttgcttctttcacttctgtgagtttcactttcacaatgtcgcctattttgtaagtgcgttcgcctttaatataaagggcaatctcatctgaattcacctgcatttcttctttattattatgtaaagtggacgcaggtataaacattgaggcgccattttctaataattgcacacgtaatccaccacgcattacatcttgcacttctgcattaaattccacattttcagccactttcggtgcaagataacggcaatatagccaatctgcaatatcacgttctacgaggcgattttggcggcgagcctcttgcaaacgtgccaacacgtcattttgtgttttttcataaggctgttttgccagcacggctttgattaagcgatgattaaccatatctgaatatttgcggatgggcgatgtccaagtggcatagccttctaaaccaagaccaaagtgcggtgctaattctgatttaaattcggcgaaagttaaataacggcgtaaacgcagttctaaataatcgctttcgatgggttcaatatcgtggcgcatttggcaatagccgtttaaggttgctaagttttctactgaataacgttctgccagttcagtttgattttgttcattggctaaatttgccattaagaaatggtgtgcgttctctaagaattttttatcaaaaccgctgtgggtgttgaaaatgcctgtttttgcctgttcgtgtaaaaattgtgcggcgcagatgttggcaataatcattgcttcttccacaatttgattggcaatgcggcgatattctgctttgatttcttgcactttgccgttttctgccagcacaaaggcataatcgggtttttctttaaagagtaaggaatgggttttgtgccattgaatgcgggctttggtaaattgatgtagccagtgaatttgttgtgctgtttctggcgtttctggctgccatgcattgtctgcctgttctaaataatccgacactttgttataagccagtttggctttagattgtacataagcggaaacaaaatgcggtttggctgtgatgttgcctgcaagatcggtttcgatataacagacaagtgcggggcgggtttcattggcgattaaggaacataattcatcggataattcacggggtaacattggaatgttaaagcccggtaaataatttgtgaagcaacgctgtttggcttcttgttcaatttgagaatctaaggcgatgtaagcggttgggtcagcaatggcgaccactaatttccagcctgtttgtgtgctgttttgtgctatgggttcgatatataaggcatcgtccatatccattgtgctttcggaatcaatggttacaaaatgaagtgcggtcagattttcgcgtgttttttgatctaacatttcataatgttctgcgccttgcacgggatagcgcgattgttcgtggcgtgccaatgtgacccaccaaggggctaattcatcgtcagctcggcaaataaactgattaattgtggcgtagaaaaagcgatcgtcacgtaatggatgggtttttaaatttgcgacgacccagtcgccctcttgcaattcttcttttaccgatttcgcctgttgtgcaccaatgggttgattaatgcttgggtgatccaccagcacttgtaatttcttgtctttattgaaccgcacttttgcgataaaacgtgtgagcattggctcaattaaggcttctggctcggcttgttctttgtcgccttgtttttcaatagtggctttgattttgtcgccgtgcatcacttttttcattgatggcggtgcgatgaaataggtttttttatcgcactctaaaaaaccgtaggctttatctgtgctttttaccacgccctcaacctgttctttgctgtcgtggatttgttgtttaagttgtgcgagtagaggattatcttgaaacataattatcttgaaacatagttattttgaaacatcgttatattttaaaaaagcgaaaaggcagactgaaaagcctgcctaaaaaagaatgtaagaaaaattattcttcgcctaattcgcccattgcagtgatgctgaaacctgcatcaacgtgaacgatttcgcctgtaatgcccgatgctaaatcagagcataaaaatgccgctgagttacccacatcttcgatagtgacagtgcgacgtaatgcagccgttttctcaaaggtggaaagcatttttttgaagtttttaatgcctgatgcggctaaggtgcggattgggcctgcagagattgcattcacacgaataccttctttccctaaatcagcagccatcacgcgcgttgcagcttcaagagaggcttttgctaggcacattacgttgtagttaggaattgcacgttctgcacctaaataagaaagcgttaataatgcggcatttggatttaagtaaggacgtgccgcttgtgccattgcaacaaagctgtatgcgctaatatcatgagcgatacgatagccttcacgagttgccgcatttacgtaatcgccgtctaattgatcacctggtgcaaatgcgattgcgtgaataaaaccatcaaatttatcccaacgcttacttaattctgcaaagcagttttggatgctttcatcggttgccacatctaaaggaagcacgatatcagaaccaaattctttggcaaattcttctacgcgcggttgtaatttatcgtttaaataagtgaaagcaagttctgcaccttgttctttcattgattttgcgatcccgtaagcgatggaacgattgcttgcaagacctgtgactaaaatgcgtttacctgttaagaaacccataatttttcctatgttgttagcgtaaaaaacttgcgtagtataagcgaaaatttgtctttgtacaaagcagaccaatatttctaagaaaaccaaccgcactttatttacaaattcgtttgagcaaaaacctaaaatcagggaaaatagcccacatttttaattgaacaaagaagaaacaatgagttatccattagaagaagttaataaacgtcgcacttttgcgattatttcccaccctgatgcgggtaaaacaacgattactgaaaaagtacttttatacggcaatgcaattcaaactgcaggttctgtaaaaggcaaaggctcggcggctcacgcgaaatctgactggatggaaatggaaaaacaacgtgggatttcgattaccacttctgtgatgcaatttccttataataattgtttagtgaatttgcttgatacccccggacacgaagatttctctgaagatacttaccgcactttaaccgctgtggatagctgtttgatggttattgactctgccaaaggggtggaggaacgtacgattaagttgatggaagtcacacgtttacgtgatacgcccattattacgtttatgaataaactcgaccgtgatattcgtgatccgatggaattgttggacgaggtggaaaatgtgttgaaaattcgttgtgcgccaattacttggccaattggctgtgggaagttgtttaagggcgtttatcatcttgcaaaagatgaaacctatttatatcaatcagggcagggttcaaccattcaggcagtgcgtgttgttaaaggcttgaataatcctgaattagatgttgctgttggcgatgatttagcacaacagcttcgtgatgaattggaattggtgcaaggcgcaagtaatgaatttgagcaagatgcctttattaagggcgagcttacccctgtatttttcgggacagcattaggtaattttggggtggatcattttcttgatggcttaacacaatgggcgccgaaaccgcaatctcgtcaagcggatacaagaacggtggaaagtgcggaagaaaaattcagtggttttgtgtttaaaattcaagccaatatggatccgaaacaccgtgacagagtggcgtttatgcgtgtggtttcgggcaaatatgaaaaagggatgaaacttaaacacgtccgtattggaaaagatgtggttatttctgatgcgctgacttttatggcgggcgaccgtgctcacgccgaagaagcttacgctggtgatattattggtttacataatcacggtacgattcaaattggcgatacgttcacgcaaggcgaaacgctgaaatttacaggcattccaaattttgcgccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatggaaaaaaatttgaagaatttaaacgtaaaaacgagcaaaatttagccttagatggcggcgataatttaacctatattgcaccaacaatggtaaatctaaatttagctcaagaacgttatcctgatgtcgttttttacaaaactcgcgaacattaaaatgacaaagtgcggtaaaattctaccgcacttttccagaaaaaaagcgttgaaatttaattcaacgcttttcttttatttagagagattttcttgttttaatcgccaaagttgataaatatttaccacaactaaaaaggcatttaataatgcaacggggtatgctgtgataattacgctgtaaataacaaataaaatcgcgccgatactatttacaatgcgtaaatacacaatagatttaaataaaaaagatacagcaacaaaaaaagtcgccatataacctaaaaactcaataaaattaaaatccattattttgttctctttgattaaaaataaaaacggtgggtatgataaaagatttttaacgtaaggaaaagataagaaaaagaagcaaccgtttgcaagggaaatttatataaaaataagttgaacgagagccatatagaaaagcgtaccaacagcaatagatagaaacatatttttcttccagaaatgtaagccaagcacgactatccctgcaagcaaatcaggaataccgtgatagccagttaaaatctcaatatttttatagcaataaacgacaagcataccaaacattgcagggggtaaaacttttccaagataacggatatattgtggaatggggcgattaacaggaaatacaaaaaatggtaataaacgtgtaaattgtaccgccactatacaaattccaatggtaatgatttgttctgttaatgtcattttaaagattccaattttgtttctaatttagttatgcgcatagttagaattaaccaaatgccaattaatgttggaattaaaaaatattcttttcctataataagtaaaaaagcaaatgcaatccctaaacctaagagagagctttcgtgggatttttcttttagccaattttctgcaaaaataactaagaatagtgctgtcattgaaaattccacaccttttaaattaaaaggtaaaacagtaccaaataaattccccattgctgcgccaagtacccaataaatatgcaaatataagctcacaaaaaacatataccaacctttatctaagtgctgtgggatttttgccatataatttagggaaaaagattcatctacaagtgttgtgattaaataccaacgtttttttcctatatgtatgccatatttttctagcattgatatgccataaaaaatttggcgggcactaatcattaaggtaattaataatacgctgattggagagaaaggtgcaataagtgcgcctgctgcaataaattcaacagaacccgcataaataagtaaagccatcaaagtaggatataaaaatccgaaaccaagtgctttcatataaataccgtatgctatgccaagaaataaaaatcctgcaatcattggtacgctgtagggaaaagcagccttagccgcttcagtaattgggttagagtgttgattttgttgagataaattcattaattatgtctataaatttaaaacagaaagtccgggtaaagttgagaaactttgagatttgactgtttgataaaaatcttctaaataagaaagggattcatcttctttgcgaatcgccgcatatagattgctatataaaccttcttttgtgacttttcttgccacgacataacccttttccaaataaggcagcgcagcccaataagggatagtcgcaataccacgacgactcgcaacaagttgaatcattgcaatagtaagttctgttgtacggcgagtaggattaatgccttttgatttaagcactttacgccatagatctaacatatcgtcaggtacggggtaagttacccaagtttcatcaataaaatcttccgcttcccaaatatctttttctgctaaagaatgattttttgagcaaatcccaaccatttcataagaaaagagcggtttaaaaatgacatcatcattatgctctatttctgatactatcgcccaatctgctcgatgggaaagtaataaaccaacgggatcagtatgaaagccagatacaatatccagttctactagcccccaatgctgacggaattcatccatcgctggcattaaccaatcaaaacaagtatggcattccaccgctatacgtaactgtcctgcatcgccgtgttttacccttgcaagatcacgttcagcatcaatcactttcggcattacttcattcgcaagacgaattaaacgctctcccgctgaagtaaaacgaagtggattacttttacgctcaaataaaggcaagccaaattgttcttctattaatttaatttggtgagaaagggctgattgggttagatatacgtgctttgcagctagagaaacgctgcctgtctcttttaaagccaataaagttttaagatgtctaaattctagaaaggttggtttcattaataatattcatataaaattaagaattagggaaccagtataatacattaaaattagaaatatgctaattaataaaattaattatttagataattattttagttaaaatacaaaaccccagtccttaaactggggttctatatttattctttatctaatttgtttaattctgtttttacttaatttaattttatctatcttagataaatttatatttagattttttatttggtaacctggcggtgccctactctcacatggggaaaccccacactaccatcggcattacagcgtttcacttctgagttcggtatggtctcaggtgggtccaccgcactatcgccgccaggataattctttgataactcgtcttctcttttatctctcgtctcttttatctctcgttactcagtctttactctacctttcactcgttcttattggccacaagctgaactcaattttctctctattaagtcttctatatttacttttctttgtttagtcttttacttcggtttccgctctacttttatttgcttcgcttttcatctcttacttcacttagctcccaaaaacacttgagcgttgtatagttaagcctctcgggcaattagtatctgttagctcaatgtatcactacacttacacacctgacctatctacgtcgtagtctacaacaacccttactgacttaaagtcagggatgactcatctcttggcaagtttcgtgcttagatgctttcagcacttatctcttccgcatttagctacccagcaatgcctctggcgagacaactggaacaccagtgatgcgtccactccggtcctctcgtactaggagcagccccaatcaatcatccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctcttgcgatgacaccatcaattaaccttccagcaccgggcaggcatcacaccctatacgtccactttcgtgtttgcagagtgctgtgtttttaataaacagttgcagccagctggtatcttcgaccggttcaaccttcgcccgctagggactacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacaggtgcgataacctaacctactccgtcccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagctaacctctcgattaaccttcatccgcttacacaacgctcccctacccaacaggcgtatcactaataatccttacttcaaaaataccccgactcaacgttcgggttgcttgaacaacctttcatgccgcttcgcgccattctagcttgttaatcgtaaggcgtattagtgatacgcctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaatccgggatggacccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactagacgcccagttaagactcggtttcccttcggctcccctattcggttaacctcgctacaaaatataagtcgctgacccattatacaaaaggtacgcagtcaccccatcacttaatcccactgcttcttttgggtggtttgactcgcttcgctcctcttaccattgtttaagtgcggttgcttttcatcaccttccaatcggattaagtgatggggctcccactgcttgtacgtacaaggtttcaggttctatttcactcccctcaccggggttcttttcgcctttccttcacagtactggttcactatcggtcaatcaggagtatttagccttggaggatggtccccccttcttcaaacaggatatcacgtgtcccgccctacttctcgttagcttagtaccacaatatggtttttagatacgggattatcaccctctttgattgtgcttcccaacacattctcctcactatactgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagattttatgcaaaacaggttttgtttttagagttcccttttcagttccctcctctcactttcctatcttgcctactcagactttctctcgaaaatctcttgttttcagcttgtttccaattttttaaagaacagttgataaaacttttcagttatcatcgttaaataaactaaaactaaaacaaaattaaatttaaaattaaacttaaaataacctaatatttaaaatagcttcatcactaccttaatactttattaatttgtctttttctaatttatttaacgatgataagtggtggagataagcgggatcgaaccgctgacctcctgcgtgcaaggcaggcgctctcccagctgagctatatccccatttcatcataatttaataactaattatttaccttttagttattatttatttacactacacctttcgcttcactcactctcagagtggtgggtctgagtggacttgaaccaccgacctcacccttatcaggggtgcgctctaaccacctgagctacagacccaagggtaatgttttcttctgctcatttgtctacaactatcagccaatctgtgtgagcactcgctgtctctcgtctttggtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcgccagagttaaaccccaacccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcccaggttaagcccggggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtgctattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctatacataaaacactacttaaaaaagtaatgatgaattttcagttaagcacctattaagacttcaaaattaaaaatagttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagggattttcaaatcccttgcaagtactttttgcaaaaatttttgaaaagctcgaccgtttgttgaaaatacatacgtaaaatacataattccgccaacaaacggttgatttttgatctcaatttataaattaaagtttacttagatcaaccaaagcctctggtttaatatcgacaatagtacgattgctggttaatgtcatcgctacgcgcatctcttttttgaaaatgtcgagcatattttcaacaccttgacgacctgctgcccctaaagcataaacaaatgctcgacctaacattgttgcatctgcccctaatgccaacatacggactatatctaaaccattgcgaatacctgaatcggcaataattttaatatcccctttcactgcatcggcaatcggtggcaacgctcttgcacttgaaagcacgccatctaactgacggccaccgtgatttgaaacgacaattccatcagcaccgaaacgcaccgcatctttcgcatcttcagggtcgagaatgcctttaatgaccattggaccttcccaaaactcacggatccactctaaatctttccacgaaattgatggatcaaagttttctgttagccagccaatatagtcatctaaacctatttgtctacccatataagttgaaacattacccaaggtgtgcggtttgcctttgatacccacatcatacgcccagaatgggtgtgtaaagccttgtaatacacggcgaatttctttgtaaggcccactcatacctgagtgcatatcacgataacgcgcacctggagtaggcatatcgaccgtaaacactaaagtagaacagcctgctgctttcgcacgctcaagtgcgtttttcataaaaccacgatcttttaacacataaagctgaaaccacattggacgcttaatcgcaggggcgacttcttcaattggacaaattgatactgttgaaagggtaaacggcacacctttattatctgccgcttgtgctgcttgtacttctccacgacgtgcatacattccgcacgccccaactggtgcaagaatagttggcattgaaagtttttcaccaaataattctatactagtatccaattcagacatatcttttaagacacgttgtcttaaagcaatattttccaaatcactcacattacgcgcaagtgtttgctcggcataagaaccgccatcggcataatggaacataaagggaggaacacggcggcgcgccgcttcacgataatcgctagctgatgaaataatcatttttacctcttattcaataaaatagtgagaaacctgagaggcattataacactattttaacaaattcaataaaaatcataattattttgagaactagatcacaatttattttaaaaaagtgacatatagaaatgatataagtagaaaaatcacctataaaattaggaaaaattgtgaatttatcaatatcacacaattaatctattaacttttaatctattttgattacttccaaagattcaaatccccatagatgtaaagcttttttaaattgagattcttcgggaaaatgtgcggtgcaaaacatttgattatatttttcattttgcacttgtagatttttatcatcaagtaaatatttgatccgtttagcaattgctgcgctcggatccataaaatatttaacttgtggcaagcataactgaatttcatctttgatgagaggaaagtgagtacaacctaaaactaatgtatccaaatctgccatgcctgcccacgaagataactcatcttttaaactaatgagatcaacggaatgaccacgaattttttgctccgcaatttcgactaattttgtcgttcccagtctctcaacaatacaatcttgcgcaaatttatcaatcaactcatcgatataatgacgctttactgtaccctttgtagctaataaaccaatatgttttgtctttgttatttctgatgcaggtttaatagcgggaacagtcccaatgataggaatctcaaaagcagctcgcaaaggcggaagcacaacagtactcgctgtattgcaagctatcacgattgcatctaatggataacgttgattaataagctgacacgccgctaaagtgcggtgaataatactttcttcttcgcgttctgaataagggaatcccgcattatcaaagcaatagagataatgccaattgggtaataattttttagcttcacggtatacgctaaacccacccactccagagtcaaaaaaaagtacagttgggcgtttttcttttttatccatttaaaactctttgaaaattgaccgcacttttaagcgttcgagtaaatttctttattattgagccagcgacagattaggctttctgccacatcagggtatttttggataagtgatttcgcataatgttgcaccgttggtatcatttttctatctcgcattaaatttgctattcgcaattcagcaattcccgtttgtttcgttccaagtacttcacctggcccacgaatttctaaatctttttccgaaataacaaacccatcttggctatctcttagcacttgcaaacgcttttgcgaaactttacctagcggaggtttatacattagtacacaaaaagaagccgtgctgcctcgaccgacgcgccctcgtaactgatgaagctgcgataaacctaaacgttctgcattttcgataatcatcaaacttgcattcggaacatcaacccccacttcgatgactgtcgtcgccaccaataaatccaattctgcatttttaaaacgcatcatgacatcttgtttttcttggggtttcatgcgcccgtgcactaaaccaatatttaacatcggtaacgctttcgttaaatcttcccaaatcgcttcagctgcttgagcttctaacacctctgattcatcaattaacgtacacacccaataggcttgacgtttttcattaacacaagcgttttttacacgcatcacaatttcagcgcgacgttcttcagaaaccactacggttgttatcggcgtacgacctggaggcaattcatcaataattgatgtatccaaatctgcatatacggtcattgccaacgttctcggaatcggtgtggccgtcataattaactgatggggatgaaatcccgctttttcgcctttttcacgcaacattaatcgttgatgcaccccaaaacgatgttgttcatcaataatcactaatgctaagtcggaaaactcgacttcttcttggaataaagcatgcgtccccaccaccatttgcacggcaccagttttgattttttcaagctctgcttgtcttgattttccttttactttacctgccaaccagccaacttcaataccgaaaggctcaaaccaccgtctaaaattattcgcatgctgttctgcaagaatttctgttggcgccattaaggcgacttgtttgccattatcaattgcagttaaagcagccaatgcggcaaccaatgtttttcccgagcctacatccccttgcactaagcgcatcatcggataatctttgataagatcttgttcaatatcggacactactcgcttttgcgcattagttggttgaaatggcaaggtggctaaaaatcgctgtttcaaatctgtttgataatgtagcggtaaggcagaaaattgttgcgttcctaaccgcactttttgcatagctaaattatgtgccagaagctcttcaaaaattaatcgttgttgtgcaggatgcttaccttgctctaacatttctaatgaaatatctggcggcggacgatgcaataatcgcaatgcctcttttaagctatattgatgtggattaaattcattaggcaaaatttctgcaatctgaaccttgtcgagtaatgtcaaagcctgatccgttaattttcgtaatgaattttgttttaacccctccgttgtggaataaatcggcgttagggtttcttccaatactatgggcgcattatctcgcacaatttgatattctggatgatgaatttctggcatatggcgaccacgtttcacttcgccaaaggcctttactcgcacacctgcttgaaaactattacgcattcccgcattaaaattgaaaaaacgtaacataattttcgatgtgccgtctgacaaacttaccgataaaatcgggcgacggccaaaagcgacttcacaggtttgtacaattccctctatagtaaaatattgttcagggcgaagattagcgattggcgtaattcgcgtacgatcttcatagcgaataggtaaatgaaagagtaaatcttgcagattctgaatgccgattttagccagtttattagaaatggcagcccccacaccagaaaggctggtcaaaggcacggcatcgagaagttcaaggctcatagctcattaatattgcgtttgacattaacgacgccagtgatgcctttaatacgatgaacgatattggcaaggtgtttgatatcttttacacaaacctgcaaaatcacaagcaataaattgttctctaattcttccgtccaaatattttggagactgctttcgctcgctgaaattgcggtcattaaactaagcaaggcattctgctcattcaatatttctatttgtaattcagcctcaaaattcaccgcactttgaacgttatcccatttagccaacgattgacgacaagcatttttcaaacttgcacaatgttgatggtgtaccacaactgtatttttttctgtacaacatcccacaataggatcacctaggattggatggcaacattgcgcaaattgtgttttacccacttgcattggtgcaatagtgagtatttttgattcaaattcgagattcttagtattagcagattctaacggcacgcccacaaattgatgcgcaatcatggaggctgactgattacctaaaccaatttctcgtaataattcatctaaagaagaaagggctaaagcatctaatacagtgctaatttgttgaatagaaaaatcacctaaattatgcggctgcaatgctacattaagctcaacttcgcctaatttcaccgcatcctcttcacaacgctgtttgagataatggcgaatccgtgttttcgcacgagccgttaccacaaaatttaaccatgcgacttcaggatgcgcatttggatcagtaataatattgactgtttgccctgattcaagggcttttgaaagtggataaggtttatgctcaacagtcacgccaacacaagtattccccacatctgaatgcacagcataagcgaaatctactgctgttgcgcccattggtaattcaacaattcgaccttttggcgtaaaaacataaatttctttcgggaaaaactctgattttacattctcaataaactcaaacgaattacctacactttgttgaatttcgaccaaactttgcaaccagcgttgtacgcggatttgtgcggttgtactatcgtttttaccattttctttataaacccaatgcgcagtaatgcccatttcagcgacttgttccatatcctcagtatggatatgaacttctacgggaactcctttcggcccaatcattgaagtttgcaaagattgatagccatttgctttaggtacggcgatataatccttaactcggcctggacgtggcttataaagattatgcatttgccccaaaatgcgataacaatcatcaacatttttcacaatcacacggaacgcataaatatccataatagagtggaattcttgatcctttatacgcattttttgatagatcttataaagatgtttttcacgtccccacactcgggcaaaaatgcctgcgttttctaaccgcactttaatctcttgtgaaatacgttcgattaaatcttgtcgattactccgtgccacatcaacgagtttttttaacacctcataacgatgtggatgcattgcttgaaaagataagtcttctaattcatttttgatatgctcaatacctaaacgatgagcaagcggacaatagatttcaagcgtttctttcgcaatacggcgacgtttatctggtcgtaacgaaccaagcgtgcgcatattatgcgtgcggtcagcaagcttgattaacacaacacgaatatcgcgcgtcatcgccaaaatcattttgcgaaaattctcgacttgtgcttcttggcgagtacgaaatttcaacttatcgagttttgatacaccgtccacaatttcagctacactggcaccgaactcttctttcagttggttttccgtataaggtgtatcttcaataacatcgtgcaaaagcgcagccattaccgcttcgtgatctaagtgaagttgagcaataatggaggctaccgccacaggatgggtaatgtaaggttcgccgctggagcgaaattgtccttcgtgcgcatctcttgcaatcacaaacgcacgcttgatgagttcaattttatctgcgggcaaatacccttgaataattcgatctaaatccgcaaacagttccaaaggagacctacttatcgttgaaagagaaagtgcagttaaaatatcgtgattttttaccgcacttttaaaagattattctgtaattaatgcaacagctgcttcttccgtttcttgcactttcgccattttttggaattcttgtgcatccataatatcttgattaatcaaacctttttcgatttcacgtaatgcgattactgttggtttgtcattatcttctggcactaatggtgcactttgattaagttgtaattgtcttgcacgacgtgcagccgttaaaattaaatcaaaacggttaccaattttttctactgcatcttgcacagtaacacgagccataatttactccgatttgtcaaaaattactctattgaaagggcgttataatactcaatttcgccctattttgctagtagctgttgaattaacattgcattttgtttttgttgataatctttagttaagcgttccgattgcaaaatactttgtaaatcttttaatgttttctcaaaatcatcattcacaatgacataatcatattcgtcataatgcgaaatttcacttatcgcttttgacattcgttcggcaataacctcttcactatcttgcccacgaccaattaaacgacgctctaattcaggcaatgaaggcggtaaaataaaaatgctttttactgaaggcacttttttacggatttgttgggcaccctgccaatcaatatctaaaaatacatcaatgccttttgctaaattttcttcaatcgcaggtaaagaggttccataataattgccaccaaaaactttggcatattctagaaataaatcttgttcaatgagtgattcaaactcttcttttgatacaaaataatagtgtacgccttcaacttcacctgggcgtggggcacgggtcgtatgtgacacagaaaccattttttgagttgaactatctgatgccaataacgcagaaattaatgaagattttcctgcgccacttggtgcagataaaatataaagattaccttgagacatagaatatttaaccttctctaacaacttcagtctattatgcagatttctctataaaaaatcatcaaaagtgcggtgattttttacggtactttttcattctaatgatgatttgatatagatcacaaaaaagtagtagggtttatagttttataaaaatgctcgtgctatactctgtgcgttgtcttactgagtgagcagtattactcaaagcaaacagatttgtttaacttaaataaaaggtgaaaatcttatggcaattaaaattggtatcaatggttttggtcgtatcggccgtatcgtattccgtgcagcacaacatcgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtcactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtaaacttcaacgcatacgcaggtcaagatatcgtttctaacgcatcttgtacaacaaactgtttagctcctttagcacgtgttgttcatgaaactttcggtatcaaagatggtttaatgaccactgttcacgcaacgactgcaactcaaaaaactgtggatggtccatcagctaaagactggcgcggcggccgcggtgcatcacaaaacatcattccatcttcaacaggtgcagcgaaagcagtaggtaaagtattacctgcattaaacggtaaattaactggtatggctttccgtgttccaacgccaaacgtatctgttgttgatttaacagttaatcttgaaaaaccagcttcttatgatgcaatcaaacaagcaatcaaagatgcagcggaaggtaaaacgttcaatggcgaattaaaaggcgtattaggttacactgaagatgctgttgtttctactgacttcaacggttgtgctttaacttctgtatttgatgcagaagcaggtatcgcattaacagattctttcgttaaattggtatcttggtacgataacgaaacgggttactcaaacaaagtattagacttagtagctcatatctacaactacaaaggctagttaaaactttgaaaaaattaaccgctcttcagagcggttttttattatctagaatttagtttacgctctaaaaatgaacaagggatcactaaaaataatttaaaacaatcaatattcttctagcttttattcctatttaagattatattagcgcacaactgttcgctcaatgaaatcaaaaaatagggttaatatgaatctcgatctccattttgttcatcgtattcaacaacaagccaagactcgtgcaaatatgaccgcacttcgctataaagaacacggcttgtggcgagacatttcttggaaaaattttcaagagcaactcaatcaactttctcgagcattgcttactcacaatattgacgtacaagataaaatcgccatttttgcccataatatggaacgttggacaatcgctgacattgcaaccttacaaattcgagcaatcacagtgcctatttactcaaccaatacagcccagcaagcagaatttatcctaaatcacgccgatgtaaaaattctcttcgtcggcgatcaagagcaatacgatcaagcattggaaattgctcatcattgtccaaaattacaaaaaattgtggcaatgaaatctacaattcaattacaacaagatcctctttcttgcacttgggaaagttttattgaaacaggttcaaacgcccaacaagatgaactgactcaacgcttaaaccaaaaacaattatcggatttatttacgattatttatacctcaggcacaacgggagagcctaaaggtgtcatgttagattacgctaatctcgcgcatcaattagaaacgcacgatctttcacttaatgtgacagatcaggatatttcactttcttttttaccattctctcatatttttgaacgggcatgggcggcttatattcttcatagaggcgcaatactttgctatttagaagacaccaatcaagtacggtcagctttaacggaaattcgcccaactttaatgtgtgccgtcccacgtttttacgaaaaaatttatgcagccgtgctggataaagttcaaaaagcaccaaaacttcgccaaataatgttccattggacaatttctgtaggacaaaaacattttgatttacgtgcgaataacaaagctattccgttcttattgaagaaacaatttgctttagcggataaattagtactctcaaaacttcgccaattattgggtgggcgtataaaaatgatgccttgcggaggagcaaaattagaaccggctattgggttatttttccacgccattggtatcaacatcaaattaggctatggcatgacagaaacaaccgcaaccgtttcttgctggcatgatttccaatttaacccaaattcaatcggcacactcatgccaaaagcggaagttaaaattggggaaaataatgaaatcctcgtgcgtggcaaaatggtaatgaaaggctattacaagaagccagaagaaacggctcaagccttcacaaaagatggtttcttaaaaactggcgatgcgggagagtttgacgaacaaggaaatttatttattaccgatcgtatcaaagaattaatgaaaacctcaaacggtaaatatatcgcgccacaatatatcgaaagcaaaatcggtaaagataaatttatcgaacaaattgcaatcatcgcagatgcgaaaaaatatgtgtccgcactgattgtgccttgctttgatagtttggaagagtacgctaaacagatcaatattaaatatcatgaccgtttagaattattaaaaaattctgacattctgaaaatgtttgagcaacgtattaatgcggtgcaaaaagaattggctcactttgagcaagtaaagaaattcacgctactctctcaagcattcagcattaaattaggcgaaattacaccaacattaaaattgcgtagaaaagtgattttggaacgttatcgcaagcaaattgaagcaatgtatcattcacaagaagcataaccaaaaggctctcaattgagagcctttcttttctaattattcaggaaacttttcttctaaaatcaatgcaagtccatcttcattattggttgccgtaatcacatttgccgcttgtttaatttcatctggcgcatttcccattgccaccccaagtcctgcgtgttgtagcatatccaaatcattaaaattatcgccaaatgcaatcacttcattggtttgtacgccaaaataatcttccaaaaaacgcaccgcacttcctttggttgcattcttgtgcattacctctaaaaaattagcgtgggaacggcaaatacttaaatgtggaaattttttctttaaaagaacttcaatctcaatgatttcttctgcttccccaataatttgaattttatgtggcgaacttgtcgctacttcatcaaaaggatgaatctcaattttggtcacgctgcattcataaatcacccatttattttctacgtcacgagcatggcaatcattatttgtataataattcacgccaagcaaaggatgttccgccaaaacggtattaatctctaaaatatcttttggatcgatttgtacgctataaattggttcgagattttggttcaaaataagcgcgccactaaatgcaacaagcacattattcgtttcaagctgtttccaataaggcaaaatacctagaggagaacgcgccgaaattggcacaaaaggaatgccattcgccgttaaacgcttaattaccgcaacagttcgaggggaaatggtatgttgagaggttaataaggtgccatcaaaatcactaaatactgctttatacatcattactccgaataaagattatttctctgctaaataaggatcatcaaagcctaatccttgcataatttgggtttctaaactttccatttcttccgcttcatcgtcttcaatatgatcataaccgagtaaatgtaaacaaccatgcacgaccatatgcgcccaatgcgccattaatggtttctcttgttctgcagcttctcgctccacgacttgacgacaaataacgagatcccctaacaatggcaactccacctcatcggggcattcaaatggaaatgaaagcacgttagtcgggcgatcctttccacgataagttaaatttaattcatggctttcggcttcatccacaatacgcaccgtcatttcgacttcattcccttctggttgaacagcacctgttgcccactgcacaatctgctcttctgttggcaaaccctctatattttctgtggcaatttgcaaatcaaccaatacacttcccattctattctcctaaattcttttcaatttctaaccgcacttttgcacttattgaatacatataacaaacgggtgggcttatgaccacttttgtatgtataaaaatgaggggaattatacaataataaacccaccaatcccctaaatttagattacataatttatgtttaccgctaatttactctatttttaacatacaaagagacaaatcacgctatttccttaatcaacacaaaacctcaaatctctcgctcttagttggggttaattgtgaagtcgttgatgcccactataaatatttccttttccttccctagcaaaaccaattaaagtcaaattatgtttctctgccattgttactgctaaatccgttgcggcggaaatcgtgactaacatttccaccccgcaagccactgttttttgcaccatttcataactcgctcgactggaggctaaaataaaacctctaggcttacccgattttgcgtgccaaccaagcaatttatctaacgcaacgtggcgacctacatcttcgtaaatagctaacatatttccatataaatcgaaaaatgcacaagcatgggtagcaccagttttacatccaagtaattgatttttttgaagatcaataagacaactatctagcaaatttaaatcaaattgaaaagtacagtctaattttggaaaagttttatatacttgattcaattgttctgtaccacaaataccacagcctgtacgccccgtaagattacgacgatgctcttttaatgccataaatttacggctggaaagttcaatttgcacttcaataccattgcaaacttctacaacatcaatgccataaatatcttctggtttatcaataattccctctgttatagaaaagcctaaagcaaaatcctctaaattgtttggggaacacatcataactgcgtgagaaatcccgttatatactaaagaaactggcatctcaacagccagtatgtcctctttttgttgcaaaagtgcggtcaatttttctgtattttttgtctttctaaaaaagttgatagtttgtcgaatccagcactgcatttattaccagtccattagttaaatgtaaaaagtctgttaaattatttttatatttatgatctagatcacaatatttgttgaagctaatgtcatttgattatggatttatcgttaaaaaatcgttactctagccatccaataaatcaacgtttttacgatgatttatatactagagagtgttattttaacgaaatcaacataatctagctactaaacgaattttattactatctataatatctcaacaacttgttgttgaaaggagtgattatgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgatagagatacctcttacgatcaatacattaacgcaattacaccaaaagatatcgttccaaaccaagtgaactattatcgtcatacttcaaaattctttgttagtatgatgaaaactttctacggagataatgccactaaggaaaatggctggggattcgatttcttaccaaaagcagatcgcctatatgatccaattactcacgttaaattgatgaatgaaggcaaattacacggttggattttacaaggttttaacgtattaaattcactaccaaataaaaataaaacgttatctggtatgagtaaactgaaatacttagtcgttatggatccattccaaactgaatcatcagaattttggaaaaattttggtgagtcaaatgatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatggacgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggcataatatggctggaactgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgagtaaaattgaaattagcaacgatactcgcgttatccgccatagaaccccagcacgtatcagtcactggatgttggttatttgcttttttatgacgatgttcactggtgttgcatttttcttccctgactttgcttggctcacagaaattttgggtacaccacaaattgcacgcgccattcatccatttacagggattttaatgttcttcgctttcatctacttagcgttattgtactgggatcacaatattccagaaaaaaacgatattcgctgggcaaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgtggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataagctgaaatcctgaaaaagaaaaagtgcggttaaaattgaccgcactttttattataaaagtgagagaatatgagtatcaaaatcttatctgaatcagaaattaaacaagtagcaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatgctatcgagccactaaatgccaaaacctttaagagagacagtatctggcgtgaatacttaactgaaattcttgatgaaataaagcccaaagctaacgagcaaattgctgcaacaattgaatttcttgaaaaagcctcttctgctgaattagaggaaatggcaaataagctcttagcacaagaatttaatttagtcagcagtgataaagccgtctttatttgggctgcactttctctttattggttacaagcagctcaacaaattccccataatagccaagttgaaaacgctgaaaatttacatcactgccctgtttgtggttctttacctgttgcaagtattgtacagattggtacatcacaaggtttacgctacttacattgtaatttatgtgaaagtgaatggaatttggtacgcgcacaatgcaccaattgtaatagtcatgacaaacttgaaatgtggtcattaaatgaagaacttgcgcttgttcgtgccgaaacctgtggtagctgtgaaagttacttgaaaatgatgttccaagaaaaagatccttacgtagaacctgtagccgatgatttggcttctattttcttagacattgaaatggaagaaaaaggtttcgcacgcagcggattaaatccatttatttttccagcagaagacgcataaaaatatagcctaggataaacatcctaggctatatcatttgtatctataaataacaggccattactacggcattttctcgtccaccgctgggctttggataataattttttcgaatatcgacttcattaaaaccaattttttcatacaagaaacgagcagggttagactctctaacttctagccataaggtctgtacacctttttctttcaatcgagcgattaactcattcaacaataatttccccaatccattaccttgatgagagggtacaatagcaatattaaacaaagtcgcttcatctaatacggtttggcaaatagcaaaaccgataatctgattattctctattaattttaaattgagataacgctcaccttgattattttttaacgtaccaaatgaccaaggcaccagatgtgcttgctgttcgatttcatacaatcgctcgaaatcacaggcttcaatttgagaaataatagacataattaaggctgctgaatttgttgccacaacgctcgtttggcttgatgattagattgaaattgctgccaacttggcgagcgataaacctgctcagcctgcttgcaaaatggcaaagtgcggtcaatttggtcgttattttctgatagtaaccagtaacgaataggctgcttacattccatatgctggatttgatcgtaattcaaacataaacaattttcttttttaagattaaggcttaacagcacatcagccaacaaaggcgagctactgatattttcattggaaacagtgataaagcgaatattctctgccacactaattcctactgaaccttgcagtacctcggggcgatataattcccactgggaaatgcccatttcttgtaaaagaagatcgcgtctgttcataagtgaatttttaaaaacgttgcttgaaaaatagtgttaatttcttttattaatctttgctaaaatggtgcgtaattttaaccaataacccacaggattcaaagcgtgatttctctagaaagccaagttttagaacgccatctttcattttttgatggtaaatcggtattatttgctggcggtatttctgataattttcctcaaacattagcctctaaatgctcatcaatccaaatttggagttgctattttgactatgcaagaacacaaagtgcggtcaatttttccgttgaatttcaaggtcaagccgatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattagcaccctatggagaaatagcaaaaattgactctgctcgtcgttgcggtttatatcatttttcactccaaaataaaccgcactttgaacttaaaaatttctggaaaacctaccaacatcctacgatacaagacttaactatatatagtttacctggtgtatttagtgcagcggaattagatacgggcacagaactgttactttcaaccattgataataaaataaaaggaaaagtactcgatcttggctgtggggcgggagtaattggctctgtgataaaaaaaagctctactaacgcacaaattaccatgactgatattcatgcgatggcgttagaatcagcgcataaaacactttctgaaaatcaattacaaggcgaggtttacgccagtgatgtcttttctgatatagaaggaaaatttgatttgatcatttcaaatccaccattccatgatggtattgatactgcctaccgagcagtgacagaactcatcactcaagcaaaatggcacctcaatcaaggtggagaattacgcattgtcgccaatgcatttttgccttatcccgaattacttagacaacatttcggtgattacgaaattcttgctcaaacaggaaaatttaaagtgtattcagtgaaaaattagaaacaaaaaaatccccatcgcaataatggggatttttctatttattacttatggatttcaccgcactttattcatccatatatcctaaactacgcaatgcacgttcatcatctgcccaacctgacttcactttcacccaaagttcgaggtgaactttgttatcaaataaacgttccatatcagcacgcgcttccataccaatagttttaattttttgaccgcccgcaccaattaccatttttttctgaccttcacgttcaacgagaattaagccattgatttcataagtgccacgttcattcactttaaattgttcaatttcaacagtaacagagtaaggcaattcttcaccggtaaaacgcattaatttttcacggattatttccgatgccataaaacgttgcgagcggtctgtgacataatcttctgggaaatgatgcacaccttcgcgtaaagattggcgtacaattttctctaattcatgaacattattaccacgctgtgcagaaattggcacaatgtgagcaaagttaaatttactgctaagatctgtaataaacggcaataaatcatctttatttttgatgttatctactttgttaatagctaacacaactggtgcttttgcattacgtagtttgtttagcaccatctcatcatctgcattccagtgtgtaccatctacgacaaaaataattaaatcaacatcgccaatagcactacttgcggcacggttcattaagcggttaatcgcccgtttttcttcaatatgaagccccggtgtatccacgtagatttcttgatacgcaccttcagttttaatcccaacaatgcggtgacgggtggtttgtgctttacgcgatgtaattgaaattttttgtcctaaaattttatttaagagcgttgatttacccacatttgggcgacctacgatagcaataaagccgcaataggttttgtcgaattgttcggtcatttgatgtccagttcttttaaaatttgttctgctgccgcttgttcagctttacgacggctagatccttttgccacaaaagtgcggtcaattttccccgcacttttcactttgcattcaacagtgaaaatttggcaatgggcttccccttgaatattgaccacttcataagttggcaatggcaaatgtttgccttgtaaatattcttgtaaacgcgttttcgcatctttttgattatcgcctggtttaatttctgccaataactgttgataccaatttcgtatcacttgggtcgtcacagccaatccctgatccaaagacattgcgccaataatcgcttctacacaatcggcaagaatagattcacggcgaaaaccaccgttctttagctcgccagaaccaagcgacatataatcgcctaattcaaattggcgcgctaaaatcgctaaagtgggttcgcgtaccaaagtagcacgcatacggctcagttctccttcattacaacgtggaaactgatgataaagtgcttcagcgatagtgaaattaagaatggaatcgcctaggaattctaggcgttcattatgttgagttgccgcacttcggtgcgtaagtgcctgctttaagagcgcaatatcattaaaacaatagccgattttacgctcaagtcgatctaaatgattcatcttattttattgctgtaaagaagcgatcaaaacggaaacctgttggccattcattcgcttctttttctaagctcatccaaatataagtggctttccccacaatatttttttcaggcacaaagccccaaaaacgactgtcatcgctgtgatcgcgatgatcccccatcacaaaatactgcccctctggcacaagccattctgcagtttgcattccctcttgtgggaaaaattcaaggtctgaataacgacgatactcaccaattaacacgttatgtgttacatcgcctttttcagtcaattctaattcattcggaaaagcaggatttgttggattttgtgtatattcaaacgccttggtttcgcaatcaacttcacaaggtttaccatctttgccatatacaatttttaatgttttttgttccacatcaaaaatgatgcgatctccgccctttccaacaatacgcttaatataatccacaccagacatattatcttttgaacttaacgctaaattttctgcaaaagccgctcgagtagccccaagaccagtacgaattaacgcttgttgtggtgctttaaacacaatcacatcgccacgttgtggtttttcgccctcaataatggtgttttggaaaatcggatctttcacaccataagcatatttattcacaactaaaaaatcgccaacgcgtaaagtggactccattgagccagagggaatttgaaacggttcaaacaaaaaagaacgaaccaaaaataccactgcaagcacaggaaaaagtgaagacaaaaattctgaagcctcagaaatcggttcaattttggctttttcttcctcacttaaggttttaccagaacgttgttctgcacgtgccacttgacgatgacgttttggcagcaccacaaaacgatgataacaccataatacgccagaaagtgcggtcaaaattagtaacaaaatactaaaagtatttggcaactgaaaataatctaaaactttccacacaccaaagccgacagccaataaaatcacaaaaaataaatttgacataattttccttatttatcttttcctacgtgtaaaattgctaaaaacgcctcttgcggcacttctacgttacctaaagacttcatacgttttttcccttctttctgcttctgtaagagttttttcttacggctcacgtcaccaccataacattttgctaatacgtttttacgtaattgtttcaccgtagaacgagcaataatatggtttccaatcgctgcttgaatagcgatatcaaattgctgacgaggaattaactcacgcattttttcaaccaattcacggccacgatattgtgaattatctttatgaacgattaaagccaacgcatctactcgttcgctgttaatcataatatccacgcgaaccatatctgccgcttggaaacgtttaaaaccgtaatctaacgaagcataaccacgcgaggttgattttaaacgatcaaagaaatctaaaaccacttcgcccattggaatttcataagtcagcgcaatctgattaccgtgatataccatattggtttgcacgccacgtttttcaacgcaaagggtaataacgttacctaaatattcttgcggcaccagcatattacattctgcgattggctcgcgaatttcagcaatattattaagtggaggcaattttgcaggactatccacataaacaacctcgccattcgttaattgcacttcgtaaattaccgttggggcagttgtgataagatctaaatcatactcacgctctagacgctcttgaatgatttccatatgcagaagtccaaggaaaccacaacggaaaccaaaaccaagtgcggtcgaagtttctggttcatagaaaagtgatgcatcgtttaaacttaatttaccaagcgcatcacgaaacgcttcataatcatcagaacttacaggaaaaagcccagcataaacctgtggttttacttttttaaagcctggtaatacttcagttgcagaattatgttgatgggttaaggtatcgcccactggcgcacctagaatatctttaatcgcacaaacaacccaacccacttcgccacattctaaaacagtcgtatcttcttgttttggcgtaaaaatccctaaacgatctacgttgtaagtttgccctgtggacatcactttaattttatcgcctttacgtaataccccatttttaatacgcactaaagataccacgcccaaatagttatcgaaccaagaatcaataatcaatgcttgtaatggcgcattaggatcgccttctggtgcgggaatttttgccacgatttcttctaatacatcttcgatacccacacccgttttagctgagcatcgaaccgcttccatcgcatcaattccaacaatatcttcaatttcttccgctacacgttcaggatctgcggcaggcaagtcgattttattcaaaatcggcactacttctaaatccatttcgattgcggtataacagtttgctagagtttgggcttcgactccttgtcctgcatccacaactaacaatgccccttcacaagcagcaagagagcgagacacttcataggaaaagtccacgtgtcctggggtatcgataaagtttaattgataagtttcgccatctttggctttataatttaaagtcacactttgtgctttgatggtaattccacgctcacgctcaagatccattgaatctagcacttgcgcttccatttcacgatccgaaagtccaccacaagtttgaatcaaacggtcagaaagtgtcgatttaccgtggtcaatatgggcaataatagaaaagttgcgaatattcttcataaaagatagtttttctcaaaaatcattaaatttaactggcggattgtacctgaaaagtgcggaaatcgctagagatgaaaaggaaaagtgcggtcaaattttcaaacttttagataaaacaaaaccccgaataacttcggggtttcttttttttcattcaaactgaaattataggctttcagtgaaagtacgagtgataacgtcgcgttgttgttctggtgttaaagagttgaaacgtactgcgtaaccagaaacacggatagttaattgtggatatttatctgggttatttaccgcatcttctaaagtttcacgacgtaatacgttcacgtttaaatgttggccaccttcaacttttacagttggtgctacgtttactggtaattcacggtattcgatttgacctaattcgctcactgcaacaacttggtcttcagcgaattcgccttttgcacataagcaacgcacttcatttttttcgctgtctaataaccagaatgaattaagcaaattgtcatttgccgcttgagtaatttgaatacctttaatcataatagcctcctaattggcacgaaaataataataaaactgtacaaattttatcaaatcattttaaaatctcaaattattttagatttatttgataaagagcaggttatttttttaattaatttttataaatttgatctaaattaaaatttattaatttttaaataaaacttatatcaataatttaacattaatttaactttttattgaatgagtgtttttgtttataatgaataaaaacttattaataggatagaataatgaaaaactggacagacgttatcggaaaagaaaaagaacaaccttactttcaacacgctctacaacaagttcatcttgcaagagcaaacgggaaaacaatttatccaccacaagaagaggtatttaatgcattcaaatataccgcttttgaagatgtaaaagtggtaattttaggtcaagatccttatcacggtgcaaaccaagcgcacggcttggctttttcagtaaaacctgaagtagccattcccccttccctattaaatatgtataaagaactcacacaagatatttcgggatttcaaatgccatcaaatggttatttagtcaaatgggcagagcaaggggtattgctacttaacacagtgcttaccgtggaacgaggtatggcacattcacacgccaatttaggttgggaaaggtttacagataaagttattgcagtgcttaatgaacatcgtgaaaaactggtgtttttactttggggcagtcacgcacaaaaaaaaggacaaattattgaccgcactcgtcaccttgttttaacggctccgcacccttccccactttcagcccatcgaggtttttttggctgtcatcatttttccaaaacaaattcatatttggaaagtaatggaatgaaaccaattgattggcaaatctaaaccatatatctctaaaaaataaccgcactttaatctctcaaagtgcggttgaatatttcagcattttaattagccgtgataacgccctacgcctaattcatcttctttacgtgtgcgattcatcacttcttgtggcgattgtgcaatacgtaatcccatttcatcttcagtacgcaccacttcgccacgtaacgaattagtataaacatcagtaatttttacatccacaaacttaccgatcatttctggagaaccttggaaattaacaatacgatttgtttcagtgcgtcctgttaattccataatatccttcttcgatggcccttcaactaacacgcgctgctctgtgccaagcatacgacgactaaattgtgcggcttgttgattaatacgctcttgtagcacataaagacgctgtttcttttcatcttccgtcacatcatctggcatatctgcagcaggcgtacctggtcgggcagaatacacaaaactgaagctcatatcaaagttcacttgtgcaatcaaattcatagtctgctcaaaatcttccgcagtttcccctgggaaaccaacaataaagtcagagctgatttgaatatctggacgcactgcacgaagtttacgaataatagatttatattctaatgcggtatgaccacgtttcatcatcgttaatacacggtcagatcctgcttgcactggaagatgcaagaaactcactaattcaggcgtgtcacgatacacatcaatgatatcatttgtaaattctattggatgactggttgtgaaacgtaaacggtcaataccatcaattgatgcgacaagacgaagcagttcagcaaagctacaaatttgaccatcgtgcgttggcccacgataggcattcacgttttgaccaagcaaattaacctctcgcacaccttgttccgcaagttgcgcaatttcaaataacacatcatctacaggacgactaacttcttccccacgagtataaggcacaacacagaaagtacagtatttattacagccttccataatggaaacaaatgcagttgggccttctgcgcgaggttcaggtaagcggtcaaatttctcaatttcagggaaactcacatcaaccacagaacttttaccaccacgaatttgattaatcatttcaggcagacgatgcaaagtttgtgggccaaaaataatatccacataaggcgcgcgatgacgaatatgctccccttcttgagaagccacacagccgcccacgccaatcactaaatttggattatttttctttaattctttccaacgcccaagttgatgaaacactttttcttgtgctttttcacgaatagaacaggtattcaataataatacgtctgcttcttcaggtgcttccgtgagttctaatccgtgagtgcttaataaaagatcggccattttagatgaatcatattcattcatctgacagccccaagttttaatatgtaatttttgagtcattttctacaatatcgttaggtgttataaataattagtcgaataaagcggtcggctattctacagacttacgataattctggctagtgaatattcggtgaaagacactaaacaggatattttgataagctagaaaggcttgtaaatcattaaaaaataagatattcataaatatactcaagatataatgcagtatgaggtaaatattagttcataaaattaaaggaaatactagcttatcgcgattacaacgatgtgtatattcaaggtaaaccaaaaggattaaatagagctcactttttaggaaagcgcaagcatatatttataatcaactactttgtctactacaccgtcaaaatagcagttaaattaaaaaaagatcagcctataaccagcctaaactcattaataatttccaccatgccataccgatagttagatggataattaaactaccaaaagcaatgatcgcaccagtaatccaccaagattttatatcattataacctgcaccgaatgcaattggacctggtccgcctccgtagtgagttactgaaccaccataagaattagcaaagactaagcctagagcaagcaattcagtaggagcacctgttacatgtccgactgttgcaaatacgggtaccattgcagctacatatgcaccgcctgatgcaaataaataacgtacagagacacttaaggtaagaatcactattaacgccatcataccatgtccctcaaactgaagtatggtacttaaggtgtttgctaaccatttgaaaaagccagatttttcaagcaagccagacatgccgatgataccaccataccatactagggtattccatgcgcctttgctttttaagatatcgtcccaggtgacgatacttaatacaatacaaagcaccattacaatgattgcaacaatggtagcattgatatgaagtgaattagagaaaatccagccgaataatgcaattacgaataacacgctgagtgctttttcacgaaaagacattggacctaattcttctaagccttttttcgcaatggctttattatccacttttttcaattctggtggagatacccaataacaaattaacggaattaagaataagcagagtaagccgggtacggatgcagctaagaaccatttgatccaagtggtttcaaaaccaagaattggtgccattaatgaaagagctaaggcattaggagccattgcggttaagaaaatataagaggtagttttaaccaccatatatacgttcatcatcaaataacgccctgcttttttcgggcttttttctggatctgaaccaagagcaaccactacgctattaatgattggaaagataatcccacctgaacgcgcggtgttagagggcgttgctggcgagagtaaaaggtctaagaacatggtaacataacctaagcgtagggttgtgctacccattgcgccgatcatatgataggcgatacgtttacctagacctgtgattacaaatgctgaactcaaagtgaatgcggtaaaaataagccatgttgtgccagatttataaccatccaacatattgccgactttaaccaattctttcgccccttcagtattaccgatgataacgccagaaaccgcaattgcagccaataagataacgggctcgccataaggtttaagcacaagcccaacgatagtggcgatataaacaccaagtaatcgccaagctatcaaagaaagcccatcaggagcaggtagtaagaaagtgatcaatgggatagccattaaaatcaccagttttgtatttttggataatgccatattaattacctctaaatgataaaaagaaaattgttagtgctaataaatcagcactaccgcccgaacttaaattacgttcaatgcaggcggtatcaaatttcattaatgcttgtgtcagtgctgttttatctgtcacaagatgttgatctgtaagcagatcctgtgctgtttgctgtatgaaatgtaatcccgctaaaccacctcgatgaaccacgttagtgtcggagttaattgccattaaattcaacaacaaaatcagtaaacgatgttcccattctaactgatggtactcatcaaattgtggcaacaacgtttgaatgagattaaaaccattttctgcttcgccacggacacctgttaagccatatttttggaataaacgcactccagccgtactaggcaagtgttcaggataatttttcagttcatccgttaaaccttgagtaaattgtgcaacaagtgagcagattaatttaacatcaaaatctaccgcactttgaaccaaacttttttgtgccaataatcgtccaattgccgtacacactaaaccaaaagaaaaaatagcacctttgtgggtgtttacgccatcagtaactttaaacattgctttttctgctaataaacctaaaggacgaatttcagcgagaatttgattttcagacaaatgcgcggtcatcatgcctttgagaacaaactgcgtaaaaaaaggttttaaactaatcgcactttgctcaaaagtatgtaggttcatatctttgtgcgaaccgttattgatggcatccactaaaccaggttttggcgataagcgagcctcttgtattaatgccagataaacttgttcaccaatatgttctgcgaaatcatgcttctgtgcgagagattgaattttatctacaatctcatcaatctcgtgcttgcgggttctcgcacagatttttgcattttctccgcacactaaacaagttcttggagaaagatcaaaatctgtacgactcagtagattgcctttagcattaaacacatctaaatcccacaaacgagcaagaggaatgctttcttccaattcaatcatcagcacttttagcgtacgagcatctatcggtaatacaaaataggcttcatgccccgtttctaacggacggattatttcttttactgctgtaatgtttaactgagtaaaaagtgcggtcagattttctagagcttttctaaaaacataatccaacaaagcatttttttttactccacccacagcagttaaagtgatgcaaagtaaggtttgtccatattgtgttataagctgttgttgtaaaattgcacgttcctctcgagcattaagtaatgcttcaagtgaaatttctgaaccctttgtagagaatgtcgtaaaaaaatgctgcaaaatttgaccgctcttttgtataaaaataaattttcttaacgctttccatttatagggtgttggcgaaagctgaaagagctaattgagtccctttcaactctttgggtttctttcctgataatcatgggaagacaagagttaattttggctattgaaagtagatcgcttgtaatgctgattctagtctttaacttgatacaccgtatcaatcaccgaaccatcacgataacgaacaacagccacaggtttattagtaaactcaatttcttttggtttaccagtaatgctgtaagcacgttcacaaagttgttcaatagtaaacaatggaatgtctgttttgcttaaagcttcaatcaaatctggacgtttaggatttactgctacaccatgatcggtaacgagaatatcgacgttttcaccaggtgttacacaggtaatcacgttttccaccacggttggaatacgaccacgaactaatggtgccacaatgattgctacttgtgcagaagctgcggtatcacaatgaccaccagatgcaccgcgaatcacaccgtcagagccagtcaatacattcacgttaaatttagtgtcgatttctaaagcagaaagaatcaccatatctaaacgttcaacagatgcgcctttggaactgtaattcgcatattggttagcggagacttcaatatgatttgggttacgggcaagtgattcagctgcaacagaatcaaagctttgtacatctaataattttttaataagaccagtctcatgtaatgccaccatacttgcagtaattccgccaagtgcgaaatctgcagtgatattttcacgacgcattttttcttctagaaagcgtgtaacagctaatgctgcccccccagaaccagtttgtaatgagaagccatctttaaaataaccactggcaaaaattacttctgcacatttacgcgcaatgagtaattcgcgtggattggtagtcattcgggttgcaccaccaccaatttttttcgggtcaccgactgcttcaacttgcacgattaaatctacttgatcttgagctatgctgattgggtagtgcgggtattcaacaaattcctctgtgagcaacacaacttggtcagcatattcagcatcgacacgcgcatagcctagagagccgcatttactttttccagtaaatccattggcattaccgaatgtgtcacagcaaggcacgcctaaaaaagcaacgtcaatttttaattcgccagattttactaagtgaacacgtccaccatgagaatgaatatttacaggttcattcaataaaccacgagagatttgctctgcaagttcaccgcgtaaaccagaagaatagattttggtgaccacgccatttttgatatattcgacaatcgggaagtggctatcaattaaagatgaagatgcaagggtcagatttttgaaacccatttcggcaattttattcatcaccatattcaccacaaaatctccgccccgaaaagcatgatgaaatgaaacagtcataccatcttttaagccagagcgtttaatcgcttcttctagagaggtacaaagtttgcgatctttcgctgtacgagaaagggattcagatttaggcaccgcctgatagactgagcgatcagcgtgatatttttcaatacgttgttctcttgttgtcatctttttatctccctttactcttcacgaatacctgatttcgcacgttctaatacaagttttgcgcgatcaataatcggtgcgtcaatcattttaccgtttaacgaaacaacaccagccccttgtcgttcagcttctgctgccgcttcaataatgcgttttgcctgctccacgtctttttgtgtcggtgcaaataagttgtgtaacaattcaatttggcgtgggttgattaaggatttaccgtcaaaaccaagctgtttaattaacgcagcctcttttaagaagccttcttcattgttcgcgttagaatatacggtatcaaaagcctgaatgccagccgcacgtgccgcttgtaaaatagaacaacgagcaaaaagcagttcaatcccctctggtgaacgctcggtttttaagttacgtacgtaatcctctgcacccaatgcgataccaattaaacgtttagaagcgaaagcgatttggttggcttgagtgatacctaatggcgattcgatggctgctagcattttagtcgaacctgcttctcgaccgcaggctttctcaatctcagtaatggcgtgatccatatccaacacatcttgcgcgctttcagtttttggcatacgtaccacatccacacccgcacgcactaccgaattcaaatccaataaaccaaattcagaatctagcggattaacacgaactacggtctcaatttctttataaagcggatgttgaagtgcatgagcgactaataaacgagcagaatctttttctttgagcgcaaccgcatcttctaagtcaaacataatggaatctggtttataaataaagctattactcaacatggcggcatttgagcccggcacaaataacatacttcttcttaatttcatagcacagcctcccagttaatcgtttcatcagttgcacgcattgcagcagcttttactcgagcttgtaacacgcaatctaacgcccctttgtcttctacaatgacttgtgctgctgtaatgcctagttttgctaatacttcacgaactgtcgcttcaatttgttcaccaaattgttttgctactgagctattgatttcaatatcgagtgaatcaaaaggttgaacccgtacttgaacatcactggattccagtgtccctgcaacggctacttttgttattttcatagattttccttccgtatattgatgaataaaaatgtatttaaaaacgaccgcacttttgtaaataatttaacgtagtcataggcacaaactctgcgagttgagcccaatttttttcagccaaatgctttcgtactgtagaagcagaaataatgtggttgcttgctgtttttctaggtatctcgataacatttatttttggtgcattcatttcggcatccattaaccaataatgcatttggcgattatattcggcagtgatgggacaatttagctcagtaccaacaaagcgatgtgttattcccaaagcttgagcaatatgtaaacggaataacttcagatcaatctcaaaataactttcatctgtaattaattgatcttttaggaaataatttggaaatgttgcacgagaaataatatagtcagagccagaatgaagagtgatattggataaatcgaaaataccttgttgaatcatttcaaatcgttcagtgtaagaaaattgcgatgcgtcttcaccgacaataaataaatgcagatgatcacattgttgtaatgcttgctcaattaaataacgatgacctaaggtaaatggattcgcgttcattacaatcgagccaattcgattaccatccacacgcattttctcccataatgagcattgtttttgtaaacgcgtagcactattttctaacaatactacataaggattggcatcagagatgatataaaaaccacaagatttgaacaacgttgcatattcgggttttgtataaataaaaaggtgtgggcgttttagcgtgtaagctaaatcaaccaattcagtaattaattgcaaggcaacaccgctaccacgcaaagactcatcaatcgcaacacattttatgatattgcctgctaaaccgccacagacaacgatttgttcgttatcattatagccaacaacaaaatactcgatttgttcatctaatttaagcgcattttgatgtaaaaatgtctgaatgagggaaagttttttttgttcagtagaaattcgctcaaattgcatcgactctccaaaaaagaagaaaacataacatcactaccaagttagtagtatagagctattataagcgatgagcaaattacgatacaagataagctcatatttttcccaactttataatctaatattatcttaacactgcattatacattgaataatttataggcaatattggcggttattctgagttgtaaaaataaaccgcacttttgttgcaagcaaaaagtgcggtttaatttagcagaattttaaattatttcactaatccgccactggcttgtaaatcagcgtgataagaagaacgaacaaatggcccacaagccgcatgttcaaagcccatttcattggctttatcacggaattcatcaaattcagttggcggcacataacgggcaacaggcaaatgatggcggctaggttgaagatattgacccaacgtgagcatagtcacaccgttatcacgtaaatcttgcatcacttgcaaaatttcctcgttggtttcgcctaacccaaccattaaaccagatttggttgggatatttgggaatatttctttgaattcacgcaataatttaagtgaccattcgtaatccgcacctggacgaatttctttatataagcgcggtacgttttctaaattatggttaaagacatctggcggattatcttttaatttctctaaagcctgtgtaatgcgaccacgaaaatcaggcactaaaatttcaatcttaatgttaggattaagctcgcgcacagcttttacacattcagaaaaatgaccagcaccacgatcaggcaagtcatcacgatccaccgatgtgattaccacatatttaagtttcatatcttgaatcgtttctgccaatttttgtggctcttcaggatcaggcggtaatggtttaccgtgagccacatcacagaatgggcaacggcgcgtacaaattgcacctaaaatcataaaagtggctgtgccatgattaaaacattcgtgtaaatttggacaagacgcttcctcacaaacagaatgtaatccgtgacggcgcattccatttttaatgctttcaattttagctgaacttgctggaagtttaattttcatccattctggtttttttaataactcttgattaggatcgatattttttacgggaataattgaggtttttgccgcatcgcgatattttacaccgcgttccattttgaaaggcgtagacatagtattttcctaaataaaaatgcccaaattgggcatttagtttttataaaatgttataaagttgttatattatagcctaaaagatcggcgaagtgtttaattaattttgctgaaacattatcgcaatcagcttcatcttgattaacaaaatccgctaactgacacatttcaagccctgcatacccacaaggattaatataatggaaaggattaagatccatattaatattcaatgccaacccgtgaaaagagcaaccacgacgaatacgtaatccaagagaacaaatcttttttccatccacataaacacctggcgcatcaggctttggatagctttcaatgccatattcagccaaagttttaaccaccgtttgttcaagtgcggtaactaattgacgcacatttaagtttttatggcgtttaatgtcaataagcacatacatcacttgctgaccgggtgcgtgataggtaatttgcccaccacgatccgattgcaccacagggatttcactacgttgtaaaagatgctctggtttacctgcttgcccttgggtaaaaacaggataatgttgtactaaccaaatttcgtcttgcgtttcagcatttcgagtatcagtaaaatcctgcattttgtgccaaatttcttgataatcttgcaatcctaactgacgaacgataagggaattgttcatactaaataaccattttcacgccttcaactttagccagttctttatagagtgtttctacctgatcaaagttttcagcaataatatcaattgaaactgaattataagtgcctttactactgcgcttttcttttggaatataatcgcctttaatatatttttgcaccacttgtataagatcttgtgctaacccttctcgattaattcccgcaactttaaaagtcatttttgctggaaattccattaattccttgagttttgcataatcgttttctattgtcattttctttcctaaaaataaaataaatcaaaaagtgcggtcaattttcaacttgtttttatgagaataaccctttcacagtcaatactaaccaatcccatagtttaccaaaaatacccgcttctcccacatcattcatcacttgtaaattggcacttgcaatatccttaccatccagttgataaaccactttaccaatcacttgaccttttgctaatggtgcttgtaaatttttatctgctaattcataacgagctttaacctcactttgtttacctttaggtatcgtaataaagtgatccattaaagcaccaagttttactgaatttttatcgccataataaaccctttgttctgaaatttctttaccagcctctaaagttttaaatgtttcgaaattagcaaaaccccattgtaaaagtttcttactttctacttcacgacctttgtaagttggcacacccattactacagaaattaaacgcatattgtttgatgtagtcgctgaagcgactaagttatatcctgcttggctagtatgccctgtcttcattccatcaacattgatagttttatcccataatagtccattacggttagcttgtttgattttattaaatgtaaagtctttttcggagtaaattttatattcttcaggtaaatcacgaataatatgcgcaccaataattgccatatcacgcgcggaagaatattgatttggatcgtctaaaccatggggcgtggtgaaatttgtatttttcaaaccaaattgttgaacatatttattcattgtttctacaaagttcggtacattgccagaaatatgttcagctaatgcaacagtcgcatcattaccagaaacaacaatcacacctcgatttaaatctgctacagatacttgtgtatttaaatctaaaaacatttttgatgaatcagggaaattacgcccccacgcactttcaccaatggtaaccatatcggtattatggattttgccttgttttaatgcgacaccaactacataacttgtcatcattttagtcagtgatgctggatattgacgttgatctggattaagtgcggtcaaaattgcacctgaattataatccatcaatacatacgtttgagccgtaatttgtggtggagttacgccaaactgcatatcctctgcagataccgaaaaagcactaagtgccacaaaacttgataaaaatgcgatttttgttgttcttttcaacatagtgtgttcctacaattaatttttatacgtataaacaattaatggcttattatttgccattttttgtaatttagttctcacttgtgccatttttgttttgtcatcaaaaggcccaatataaatttcatatttatttcctgagcgatttacttcagtctgaatattcgctaacgcaagctgcgtaattaatttatttgcttggctatgagaggttaattcaagcattttcaaacagtaaaattcggttccttttagagcatttattgacttagatgcgttatcaaaaagcgtgttagattttaatactaaacgatcggcagcttcctgagtttttgcttgtttagccagtgtttttgtggctgcacctgataaattcccatttttagcaacgtgcaacgcctcaattcttacctgccctatgccgcgggaaattaagccaatttcttttgccgcagcgtgtgaaagatcaattaaacgtttatcactaaaaggcccacgatcattaatacgtacgataactttacgattgttatgtaaatttgtcactaaagcataagaatttattggcaatgttttatgtgctgcagtaaattgttttgagttataaacatcgccacttgctgtttttcgcccatcaaatttaagatgataataacttgctaaaccttctttaatataagatttggcttcattcccacttttagtggtataagtttgcccttttactgaataagtccttggtgcaggcatttgagttgcgatagaaagattatcccctcgaataccatacattttttgcgtatcagcctgcgcaggaaaagctacgcttatcataaatagcaaaagtgcggtcaaatttaacccagtttttaatttcataaaatactaacgcttttcatttattctttctttaagaaagaaaaaaatgaaattagctccttttcataaattgacttttatgcgtatgaatagacatcagtaaaccaaaacttgccataatcgcaacataagaggtaccaccataactaaataaaggtaatggcacacccacaacaggcaaaattccgcttaccattccaatattcacaaatacataaacaaagaaaattaatgttgttgcaccagcaagaatacgcccaaaagaagtttgagcatttacggcaatcattaaacctcgcacaataataaacaagtaaatcgccattaaaatcaaaaaaccaatcattccgtgctcttcacccattaccgcaaaaataaaatctgtatgaggttcgggcaaaaattctaattgtgattgagtcccctgcatccagccttttccgcttaatccaccagaaccaatcgcaatctttgattgtaaaatatgatagccagcaccgagaggatctttttctgggtccaataatgtgagaacgcgagtgcgttgataatcgtgcattagatataaccacatgatcggaataaatccagctaagccaatcactgcagctaaaataagccaccagctcattcctgctaaaaacacgacaaataaacctgacgcactgaccaaaattgctgtgcctaaatcaggctgaatcgccacaagcaatgttggcagtagaatcattgcaatcgctataaatgtttcacttaatttaggtggaagcggacgattacctaaatacaccgccaccattaatggcacagcaagttttacaatttcagagggttgaaaacgaataaatcccagatcaagccaacgctgcgcacctttacttgtcgtgccaatagcatctactaagatcaacaacacaaaaccaattaaataaagataaggtgcgatgcgttggtaaaatcttggtggaaattgagccattaacaacataacaataaatccaagtaaaacctgaataattcggttattaaacatcatttcactggcacctgatgcactatataacaccagcataccataagccgttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgcgctaacggtgcggcattacttgaaccaccacctgcattttctaaaatcactgtcacaaccaatctagggttttcataaggcgcatatgcggtaaaccatgcgtgatcatgcaattcttttttcaatcccaccgcattgtatttttcattttcttttaaactaaacacttgagcagtaccagattttcctgcaacacgataattggcatctgcaaaggcttttcgcccagttccatttgcagcattaacaacattgtacataccgcgtttcgctgcctcccaagccgtcactttaggtgtactaatatcaggataaattaacggatcttcataaggctctagaactgccccctcaattgctttcatcaaatgcggcgtatttactttgccattattgaccaatatcgtcgttgcttttgctacttgtagtggtgttgccgtccaataaccttgaccaatcccaaccgaaatcgtatcgccttgtacccaagggcgtttatagcgtttttgtttccattctcgagttggcatattggcagccgtttcttcttgaatttcaatccccgttggcataccaaaaccaaaatccttcatccaattagaaagacgatcaatacccatattataagccacttgataaaaataagtatcagaggattcagtaatcgctttattcaaatccgtatctccgtggcctgtttttttccaatcacgaaaacgttttgtggagttaggtaatacccaatatcccggatcaaaaatcgttgtgtttggtgtaatcacattttcagtttgtgcggctactgcaataaaaggtttgactgttgaagcgggcggatacgcaccttgtgtcgcacgactataaagcggacgagcaggatcatttaataaacgtttataatcttcggaggaaataccatcaacaaataaattattgtcataacttggtgtagataccatcgctaatacactactatctttaggatcaagcacaactacagcaccttttagtcccgataaaagttcagtaatataacgctgtaatgctaaatcaatagttaaatgaatactttttcccgccacagcaggtcggctacgcaaagtacggattactttgccgcgattattaatttctacttcttcaaaacccgtggtaccttgcagtatatcctcgtaataacgttcaatacccaattttccaatatcgttcgtccccgcataattcgcaaatttatcctctcgtttcaaacgttctacatctttatcattcattttacctacatagcccaaaatatgcgccattgtttcgccatataaataatggcgtttgaaataaggacgtacctctaaactcgggtattggtagccatttaccgcaaagcgtgaaatttgttcttctgttaaattcggctttaataaaatcggtgtataacgcgttccgcggagacgttcttttttaaaatgttcaatatcgttatccgtcaatcccacaatgtagcgtaattcatctaaagtgcggtctaaattttcagttttttccggcacaatgtataaaccaaaaaaagtaagattttcggctaataatttaccgtaacgatcatagattaagccacgcgttggcggtaaaggtaataatttaattcggttaccattagaacgcgttcggtaagtatcgaaattaacaatctgtagctgataaatattggtgaataaaacacctgttagtagcaaaatccccaaaaaagccactaacgttcggcgtgcaaaaaggttacgctccgcttttttatcgcggaacggctcatgagttggcgtattgaaaaatttttttaaattcatctggctaaaaataaggatgtattattctcgatgataaggatgattagtagtgagcgaccacgcgcgatacaaactttcagccactacaacacgaacaagtgggtgaggtaatgtcaatggcgaaagcgaccaactttgctctgcagcggctttacattctggcgaaagcccctcaggcccaccaatcaacaaacaaacatcgcaaccatcatttttccacgcttctaattgctcggctagctgcggtgtcgtccaaggtttaccaggaatatctaacgtcacaactttgccttttccacaggcagctaacatcgccttaccttcttgctctaaaatacgtttaatatcagcattttttccacgcttacctgctgggatttcaatcagttcaaaaggcatatcttttgggaaacggcgttgatattcctcaaaacccgttgtaacccaagaaggcatttttgttccaacagcaattaacgtgattttcacaagtcatccttatctaaaaagtgcggttatttttcaccgcactttactaatatttacgcccaaagtttctctaattgatacatttcacgggcgtcacgttgcatgatatgtacgatagcttgaccaagatccactacaatccaatctgcagtatttttaccctcttcaccaaaagtttcaaaacctgcttttttacattctgtaattaaattatctgccattgcagaaacttggcggctcgatgtacccgtgcaaataatcatattatccgtaatcgatgattttccacgtacatcaaaatgtacaatatctgttccctttaacccatctaaggtttccatcaaaaattcaactaacgccattttgttctcacttagcaataaaagtgcggaattctatcattgaataccctcttgcgcaaaatccacgcaaaaaataagcgcgaaattaaccgcgctttttatgtctaaattgaaattatttttactatgctgcccataataacactgccaataactgtggcgacattattcgcaagaacatcactaacggatacacagtggcataagaaagtgctgcagcaccgttatcttctttaatttcattagcaaatgctaaagcgggaggatccgtcattgaacctgcaagtaaaccacagattgtaaggtaattcagtttgccatatagacgagccaaaataccggtaatcattaatggaataaaggtgataaaaataccgtatcccatccattcaagtcccgaaccattcactaaagtatcaaagaaacttccgcctgattttaaaccgaccacagccaagaaaagaacaatcccaatttcgcgtaacgccaagttagcactaggcggcataaaccagtaaagtttaccaatcgtgccaattctcgctaagattaacgcaaccaccaatggcccgccagcaagccctaattttaacgcaacagggaaacctggaatatagaatggaatcgaaccaacgagtactcctaaaccaatgccgataaacacaggtaacatttgcacttgaagcaatttttgttgtgcattaccaatgactgaaatagcctgatttagtacatcactgcgtccgaccatatgtagcacatcgccaaattgcagtgtggtatttcccgttggaactaactcaatccctgcacgatttaaacgtgaaatcacaaccccatatttttgatgaatgcctaaggcacggatctttttgcctaatactttttcattcgttaccaccacacgctcagaacgaatttcgccactataggcaacagttggtgcatcaacttcgtatccgataattaaacgcattttggcaagcgaattatcatcgcccactaattgcaaaatatcgttgatacgaatttcagtacttgcctttggaacaatttccatatcatcgcgttttaaacgtgaacatacgacttcttcatcactaaatccaggaatttgaattaacgtcagaccatctaaattttggttcgtcacttttaaagaaatattatgtaaactttctttatcttgactgctctccgcattaaaacgtgccgcttcatcgtccactttgactttaaaaaataagcggattaaccacattgcaagcaaaataccgcaaatcccgaatggataagccattgcataagacacccccatagtcacagtggtttgaggcacccctaattctgctaaaatttgctgccctgcccccaacgctggcgtattagtaacagcaccagaataaatacctaaggcaatatccagtggaacatccgcaattttatgtacaagaaccacggcaattgaccccagcacaataatcaaaatggcaaaggcatttagctttaaaccagattttcgtaaagaagaaaaaaagcccggccccacctgaataccaatagtataaacaaataaaattaaaccaaattcttgcacaaaatgcagcgtatgcgcatccagtttcaagccatattgattagtgaaatgggcaacaataatgccgccaaacagcacgccaccaatgccaagcccaaccccgcggatcttccaatgcccgatccataagtcgattacggcgacgagggcaagaaggctaatcgtgatcgcaatatcactcatattgaccccttaaaaatgaaatttaactcctttggattatatccaagttactttttgaaaaccttaaccaaactcaaaaaatgatacgttcgtcacattttttcttgcgaaattgagcatagactctacaataccgaaaatttttgacccttttacaaaaagtgcggttatttttcaccgcacttttatctcggatggaatatttatggattacagccaagaagccattacttctcttatttggattttacaaacgctagccatcacctcagtcgtctttagttttggcatttctcctttggtgcgttttactcaatggggaagacaattttggatgtttgcaggtggttatctttcgcctaaacgtagcattaaacctatcttattctttctacttattgttgcaatgacgctacttagcgtacgtatcagccttgtacattctgagtggtacaaaaatatgtacacatcattgcaagaatttaatgaacatgtattttggcaacaaatgggcttgttctgtgtcattgccgcaagttctgtttcagcagcattagtaagctattatttagagcaacgtttcgtcatcaactggattgaatggcttaacgaacagcttgttgataaatggatggcacatcgtgcctattacaaaacacaatatttatcagaaaatcttgataaccccgatcaacgtattcaacaagatgtgcaatcttatgtaaaaaccacgctttctttaagcactggtgtcattgatgcggtaacctctatgatctcttatacgattttattatggggattagcaggtccaatgatggtacttggcgtggaaattccgcatatgatggtatttttagtgtttggttatgtcatcttcacaaccctcatcgcattttggctcggtcgtccattaatatccttgaattttattaatgaactcctaaacgcaaactatcgttattctttaattcgaataaaagaatatgccgaaagcattgctttttatgcgggcgaaaaagtcgaaaaaaatcagctttatcagcagttcaatgccgtcattcataatatgtggattattgtatttagaacactaaaattttcaggatttaacttagtcgtaagccaaatttccgtggtttttccattgttaattcaagttggacgttactttgaaaaacaaataaaacttggcgatctaatgcaaaccttacaagtatttggtcagttacacgcaaatctttccttcttccgcaatacttatgataattttgcaagctataaagcaacgctagatcgtttaactgggttctgttatgccattgaaaaagcaaataataaatcacaaacacagatccacaatcatccaacagatgtgattttcaaaaatttaagtattcaaaatccattaggtcatacactaattaaacatctaaacattaccttaccgcaaggaacaagtttgcttattcaaggaaaatctggagcaggaaaaaccacgcttttacgcaccattgcggggctttggagctatgccgagggggaaataaattgccctacgcacaatcagcttttcttgtcacaaaagccgtatgtgccacaaggaaatttaatgtcagcattagcttatccaaataacgctgacaatatttcacatacgcaagcggtagaaatattaaataaagtgcaactaggacatttggctgaacaattagaaaaagaacaagactggacgcgtattctttctcttggcgaacaacagcgtctggcgtttgcacgattaattctacacaaaccagcagtggcatttttagatgaagccacagctagtatggatgaaggtttagaattttcgatgtatcaattgttacaacaagaactaccacaaacgacaatcatcagtgtgggacaccgttcaacccttaaaaccttacatcaacaacaattaattctacaagacaaagggcaatggcaagtgctataaaaaacgctaaaaaacactgtaatcgcaacgctttttttgatacatttagtgcaattttttgtatgtttgacaaagtcattttctattttttgtcaaacaaaactaactttcattttaaacggtataattatgttatttaaaaaaattcgtgggttgttttcaaacgatctttctattgatttaggcacagctaatactttaatttatgtcaaaagacaaggtattgtacttgatgaaccctctgttgttgcgattcgtcaagatcgcgtaggcacattaaaaagcattgcagctgtgggtaaagaagctaaattaatgttaggtcgtactcccaaaagtattgtagcaattcgtccgatgaaagatggcgttattgcagacttttttgtgacagaaaaaatgttgcaatactttatcaaacaagttcatagcggtaattttatgcgtccaagcccgcgtgtattagtatgtgtgccagctggtgcaacacaagtagaacgccgcgcaattaaagaatcagcaatcggtgctggtgcgcgtgaagtatatttaattgaagaaccaatggcagctgcaattggggctaaattacccgtttctactgcagttggttctatggtaattgatatcggtggtggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaaccgcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaattagaatatgaacaaaaagtgcggttaaaaataaccgcacttttcctttcatttttttcattcaacaagagaaagtttaatgaaacccattttcggcaaagcccctcccctaggtattcgtctgcttatcgctatctttgcatctattgccttaattttagctgatggacgtaatagctcaataacgaaagcacgtagtgcaatggaaacagcaataggcggtttatattatcttgcaaatagccctagaagcatcttagatggcatttcagaaaatcttgttgataccaataaattacaaattgaaaacaaagtactacgccaacagcttttggaaaaaaatgcagatttacttttacttgatcaactcaaagttgaaaatcagcgattacgtcttttattaaattctccgttaagaaccgatgaatacaaaaaaattgccgaagttcttactgcagaaacagatatttatcgccaacaaattgttattaatcaaggcaaaaaagacggtgcttatgtaggtcagcctgtcattgatgaaaaaggcgtcattggacaaattatttccgtgggcgaaaatactagccgagtactgctactcacagacgtaacacactcaattccagtgcaagttctacgaaatgatgttcgtgttattgcgagtgggactgggcataccgatgaactaagcctcgataacgtgcctcgttccgttgatatagaaaaaggcgatcttctcgtaacctctgggcttggtggacgttttcttgaaggctatcccgtagctgttgtacaaagcgtttcgcgtgatagctctaattactttgcaatagttaaagctaaacctttagctttattagaacgtttacgttatgtacttttactttggccaagtaacctagatatatcaaaagtaaaatcaatgtcgccagaagaagttcgcaatctggtgcaaaaacgtttagaaagccaagctaatgaagcaaattatagagtgaaaaaaacacccttaacagaaaaagactttctagaaaatgaagaaaaaaccattattgaaccagatattccaacagattttcttcaaaatgaagaagatcttcccatagaacagcaagaagaaaggatagaagactaatgcaaacacgatttattttacaatggttcactattttaagcttctttgttattgcctttgtattagaacttgcaccttggccagttggtttccaaatgctaaagcctgcgtggcttgtacttgtattactttattgggtattagctattcccaataaagtaagtataggctggtcatttttactcggattaacttgggatttaatattaggctctacattaggcgttcacgctctcgtactttctacgagcatgtacatcattgccaaaaactatttaattctgcgaaatttatcactttggttccaaagtttattggttgtacttttcgtcttcattataagattacttattttcttagttgaattttcactccatactgccttttttcattggcaagccatcttaggcgcattcgcttctggtttactatggccgtgggtatttttattaatgcgcaaaatacgcagaaaagttaaattacattaaaaaagagagataactctctcttttttatgatttatgaatgtttcaaacacctaattcaatggcttattgctatccagtaaagaatcacattcccaaccgatatactctcccgaaaattgttcagccaatttttcaaaacgttctacttgttcaaaaatttcgctattttctaatgaaatttcttgctctaattttaccaagaaataaggttcgtcatcttcattaaactgaatcgcttgtgcagaatattgtaatgtcgtgaaagaataatcccctaaactaagctcatccataaaagggaacattttctgctcttcatcaaaatgaaaactatgctctactaaataggtatcacttaaattacgacctttactttttaataaatcaagcaattcttccgttgcatttaacttaatctccaatggagaagcgagcaaaaagtcaaaataagtatcccaaattaaatccttttgcacattaatatctttaacaaaatcaatttgctgtaaagtttctacaataagattttcgtgcttacaataaaaatgtatttttatttgagaattacaaataaaatgccccgcaaaaaatacatttggaagtgcggttagttgtgtcaaaattttaaatacacggttaattaacttatcgtattcaacttctgagggtaaacccgtttcatcatcagcctgataatcaatagtaaactgcactattttatcgagacctttaccgtgatatttttcaacatcttcaatatttgcggtaaacacggcaggcataccattcacagtagaacgataattctgccaatttgccatatccatttcgctttcctatttaaattcagcccaaatcggtgcgtgatcagacggtttttccattgctcgaatatctaatgcaatgcccacatcgacacatcgttcagctaatttttggcttatcaaaatatgatcaattcgtaaacctcgattatcatcaaaacctttagaacggtaatcaaaccacgagaatttatcatttgctgttgggttcagcttacgaaaactatcttctaatccataatcatacaaacgttgataccacgctctttcttcaggtaagaaagaacatttacctgtgcgtaaccaacgtttacgattttcatctccgataccaatatctaaatcacttgggctaatattcatatcgcccataattaaaatcggattagatctgtcgtgttctttttctaaatactgttgaagatctgcataaaatttctctttagctggaaatttagtctcgtgcgcacggctttccccctgtgggaaatagccattaatgacggtcaataaaccaaattcagtttccagatcagccataataatgcgtttttgtgcatcttcattgtcagttggaaaaccacgacgaatcactttaggttcttgtttagtcaataatgctactccataatgacctttctgaccatgatgaaatacgtgataacctaagttttctgtaatttcatagggaaaagcctcgtcagcaactttaatttcctgtaagccaatcacatctggctgatatttttcaataatggcttcaagttgatgtgggcgagcacgtaacccatttatattgaaagaaataaatttcatttttgttcctattaaagagtgaaattggctttattatacagagatttctattttgataaaaacggctttgtcagataaacctgaatttgctcaaatactgtaggcttaatccaaaattgaccttgagaaggtaaacaagtgaccgaaataaaatcatttagataatcaaattccaattgagtagcgtgcaaataagtgcggtcaattttttctgtgtttttaccataaagcccatcgcctaaaatcgggctacctaaacttttcatcgcaacacgtaattgatgcgttttccccgtttgtggttttaaaataaataaacgtaaattaggttcacagcttacacttgcaaaacgtgtaattgctggattttctttggtttgacaaagtttccatgcaccctctcgggatttcttcatatccccgataatcaaaccttgtttctttttaggcttttggttacttaatgccagatacgttttatgtattttatgttcagaaaaaagtcgtgaaaattcagccgcactttcagcatttaacgccagaattaacaaacctgaagttactttatctaagcgatgaaccaaccatactttaggcacattcagttgttttgcaacaagttctgttaagccttgctcttcttgatctttatgaacgctaataccctcagacttgttgataataataaaatcgctatgttgataaacaacctcgatttccatcagatttgctcctttttgtaaattttatttttaccgagaacaatatcttttaccgaactaagtaattcctgttgaatatgtgagagttttggtttttcgtttaattgaaatgctaacggacgacaaagttccattgctttcacgcctaatctagcagtgagtaatcccacaccaattccttgagcgatacgtgtagataattttgctgtcacatcttgagaaagccaatccattccaatatcttgtgccacttcggttgctccagcaaaagcgatattgaccaataccattcttaacaatctaatacgtgaaaaataccctaattcaatcccataaatttcagcaatcttattcattaatcgaagattgcgccacgcgataaaaaacatatccactacagcaagtggactaatcgcgacaatcacagctgattcagctgccattttactaatcaattttttagcttgtgcatcaaaagaagacaaaacatgacgactgaataaatgagcaatttcttgcgccgaataagcttcatttaattggtgttgccattgaattaccgctggagaatcattttccaaacctaaagattctgcaatatctaagcaaagaattttacttttttctgcgttatgaacggaaaaaacatcgccattttttaccgcactttctaaccaaatctgctgactttgttgttgccattgctcacgtttttttaaacgaactaaacgtcgccactcgccaataatctctttaatccccaataaaatgataatcaaactgactaaagcaaaagcaagataaatccattgatgttgttgatagctatcccaaatccactgcatggattgtgcaaccgtcgccaagccaaataaaagtgcggtaaattttaataaagtttttctaaaactggattttggtttcaatgcttgttcaagttgagcatcaagtaactctccatccaacgcttcatctagctttgcttccatattatggaattcttgcttgggctgatagtgttcttcctctacattaactgaatgttcaaaaatttgtttttccattgcctattccaaaaaataaccccactaaatagtggggtcataaagtcaaaattcaatcattattcatcacttgaaaagatagaaagtaatcttaataaactcaagaataaattgtagattgaaacatagatgttcacggttgcgcgaatgtaatttgtttctccaccgtgaataatattactggtttcatacaaaatggtcattgttgagaacactacaaataatgcactaattgcgaccgataacgcaggaatttggaagaagaaactcgccaccataccaagcaataacacaataaataatgcgaacattgcgcttgataaaaatgacatatcttttttcgtagtcaatacataagcggaacacgcaaaaaatacgatagcagttcctgcgaatgcaagcataatcaaatcttccattccacgtgccacatacatatttaaaattggcccgatggtgtatcccataaatccagtgaaagcaaaggccgccaaaataccagcagggcgatcagctaatttattggttaagaaaagtaagccataaaaacccactagtaacacaataatatttggataaggcaagtttaagctcattgaaataaacgcaacaaccgctgaaaaagccattgttaatcccagtaaaaaatacgtgttacgcaacactttatgtgtgctgagtaacgattctttttgagcatccacaataagacgtgattgcataaaagctccttgtaaaataaataaaaagtcttctgtaaagtaagggctagggataaaaaagtcaatggtattaatggaattaatttcatcaaaatgaataaattatcatcatctaaagttaaatcatcaaatttctatttacatcaataaaatattcattatactacgcccatcaatcacggaggaatggtcgagtggttgaaggcaccggtcttgaaaaccggcgagggtttacgccctcctagggttcgaatccctattcctccgccatcagaattaagaaatccctaagtcacacggcttagggatttttactttgtattacgttatttggtcaatccattcactagtgaaataacagtctgaatatcgctatcaaacaattttccttctttcacaaattttacttttcccgttttgtctaacacgataattgcactatctttagaatttaatccccaagcattttttaccgcacttttatcatctaacacaacttgactatgtggattttcctgtttgcctttttgtgcactattttttacaaacatacctgtaccaacaatcgcatcatccgcattaataatagtggttgtttggtattttacaggattaaaatgggatgcttttatcgcatcaatcatcgactgatttttctcttttgcagccgttctacccgctaaatgatgaacaacacgcactttacccgctaattccgcagaaccccaaggttgaaacgcagtatcttttcctgaaagcacaatttcaccgtactccgttacttgcactgctggtaaagattgctctaattgcaaattgtgtgcccaagttgaactactaaacattacgccacaaactaaggcaagaatttgttttttcatacattttcctcaaaaatttatcaaaaactttcacgctttggcgaaagacatctttttgctatactcgtgcgcctattatatgtaatcaagaaggaaaacccaatggatcaaatgcctaattgcccaaaatgtcaaagtgaatacgtttaccacgattcaattaattttgtttgccctgattgcggtaatgaatgggataataatgaaattcaagaatcagatgacgatcaactaatcgtaaaagacagcaatgggaatttgcttgcagaaggcgacaatgtacttttgattaaagatttaaaattaaaaggttcatcagaagtattgaaaaaaggtacaaaattcaaaaacatccgcttagtaaatggcgatcataatgtcgattgcggcaaaatcatgttgaaatctgagtttttgaaaaaggcttaatcgaaaaaacgcggtctaaatagaccgcactttgcactttaaagaaataaatttatttaataatctcaatcacttctctgactaatcgtccaatttcatcccaatttttggattgaatcaattttttctccacaaaccaagagcctccacaagcaacaatattaggaatagcaagataatcccttatgttatgaagccctataccaccagtcggcattatctgtaattgagcataaggaccgagcaatgctttaatcattttcactccgcctgaagcctctgcagggaaaaattttaccgccgaaattcccatttctaatgcaatttcaattgccataggattattcacccctggtgttattggaaaatttaaatcttgacataatttcacaatttttggattaaatcctggtgttaccacaaaatccgccccactacttttagctaaaactacttgttccgcagttaaaactgtaccggcagcaattaaaaagtcaggtctatttgcacgcaacaaacggatcgcatctgccgctgcttcagagcgaaaagtaatctctgccacaggtaaaccatttttagccaacgtatctgctagcggcaaaatatcgtctgcattatccaacgcaattacaggcacaattttgagttcacgaagtttttcaataatttgttgagttgtgtatgacataattttccctatttaaaataattttttgcattgttgaaacaaatatcttcaatcattttacccagtaatgaaatgtcatttggagcttcacctttttcaacccatccaccaatcatttcacacaaaatacggcggaaatactcatggcgagtgtaagataaaaaactacgtgaatcagttagcattccaacaaattgactgagtaaccctaattgagaaagctgttgtaactgacgttccattccgtctttttgatcgttaaaccaccatccagaaccaaactgtattttccctgcaataccatcgccttgaaagtttccgatcatactagcgatcatttcattatctcgaggatttaagcaatataaaatagttttaggcagttgattttccttatccattgcatctaacaaacgagagaggggatatgcataagttcgatcaccaatggaatcaaagccactatctgcaccgagtaaagcaaacattcgactattattgttacgtattgcaccaatatgcatttgcattacccagtgacgtttacaatattccgaagccaaccagactaaaattgcagtactaaattgagcaacttcttcttccaagagcggttgattttgcaaacgtttttgtaaaatactattcaatactgattcatctggaatagctgaaaaacggacaatttccataccatgatcagcagatttacaaccttgagcatcaaaatattcgagacgttttaacaacgctttttttaaatctgcaaacgtataaatatctacatctgcaatttcacttaactgtacaaggtagtcattaaattgtggcaactcaattttgaatactttatcaggtcgccaacttggtacaacatcaatatcaaaactttcatcattcttgattgcttgatgatattgcaaagaatcaatgggatcatctgttgtccccactaatttcacgttcattttctgcataatgcctcgcgcagaaaattcaggttgttgcaacatttcattacattgatgccaaattttttccgcattttgcggattaaataacatattggttataccaaaaggacggcgtaattctaaatgtgtccagtgataaattggattaccaatacaaagggggactgttttcgcccaagccaaatatttttgatagttagtagccttccctgtaatcaattcttctggtactccagctgtacgcaaagctcgccatttgtagtgatcaccctctagccaaatttcagctaaatcattaaattgacgattttccgccacttctcttggatttaaatgacagtgataatcaaaaataggtttatttttggcataatcatgatagagaatttttgctgtatccgttgaaagaaggaaattttcatccataaattgcttcattttgccctcctatactccactatacgcagaaaaaccgccatcaacaggtaaaactacgccattgacaaaagcagaataattttcatctattaagaaaagtaatgcaccgagcaattcttctgactcaccaaaacgtcccattggtgtgttagtgaggattttatttgctctatctgttggttttccttcagtatcaaataataaagtgcggttttgattactaactaaaaatcctggtgcgatagcattacaacgaataccaacttttgagaaatatacagcaagccattgagtaaaattactgattgcagcttttgcaccagagtaagcaggtatctttgtaagtggtgtaaaggcattcatactggaaatattaataatatttgccccttgtttaccaagcatatcttttgaaaaaacttgggttggtaataatgaacctaagtaattgagattaaatacaaattctataccagatttatctaaatcaaagaatgttcttgtcgtttcatttaaatcaaattgatggaactcattatctgttgtcgcttttggattattcccaccagcaccattaattaaaatatcacaagtgccaaaatcaatagctatttgatcacgcacttctttaatattttcaagttctaacacattagttttataagcttttgcttttccacctgattggttaatttcttttgctgctttgtctgctgcctcgaaattcaaatctaacaaggcaatattagctttagtatacgctaactgcttagctagaaatgaacatagcactccgccagcccccgtgattataattagtttattttctaagttatggtttgctgcaatattcatagtaaactccattaattaaattcagattgaagatgagacgttgcgactttatctataatcgcacctttatattgaatgatgatgccagcaatacgattgccttgctgacaacaagtttcgagaggtttatttcgtaaataaccgttcagaaatccagcattaaaagaatcaccagcagaggttgtatctaccacatttaaaataggttcagtcatcacttgcccatattgagataaatacctatctgaaaaaatagcaccattcttaccgcacttcacaatcacttttggtataccaattttatgtaatcgttctaaagtatccctagatgttttatctttccataatgcttgttcatcatcaaaagtcaccaaagctatattaacactaggtaaagctgcaaataacaatcttgggcttcttctaatgaatcccaaagtgcagggcgataattactatcaaaaacaatttctgcgccttttttagctaaagaagataattgctcaattaaaaaagtgcggtcatttttcggtaagattgctaatgaaataccacttaaataaatcacatcaacttgctgaagttctgcaataaccttagcaaaatccggatgttgaaccatataatgtgctgcagattgattacgccaataaaggaacgtgcgttcgccttgagcatctaattggattagataaagacctggttgatgctgttcatcctgtaaaacccaatttgtttggatgccatcagcttgccaatatttaagcatttgtttacttaaattatcagttcctaatgcagagacataatgaacttgaatctcttttgatgaacttactcgactaagataagttgcagaatttaaggtatcaccaccataactttgccacatttccgcaaagggtttcccattgagttcaatcatacactcgccgataaatgctatttttttcatgatgcaacttcctaataaatcaagataaccaattcattggaacaattacaatttcaggaaaaaatacgatcaacatcataataattgcgtacacaaataagaatggagcaattcctttggataatgctcctatccctaattttgatatccctgagcctacatacaaaactgttcccacaggcggtgttattaatcctatagataaattaatcaccatcatgattccaaaatacgcaatatcaatattatatgctcttaacactggtaataagactggaacaaaaattaataccgcaggaattaaatccattacacatccaacaagtaataaaaatagcattataataaacattaaaattgtcggactatcagttaatcctttaatcgtttggactaattctgttggaatttgagcaactgtaatcgcaaaagcagatatcattgctgatgcagcaacaaacattaccattgatgttgttttgatggtgccaatgaagacgtcttttaatttagaaaatgttaagcctttataagcaatacttactatgccagcataaattgcagcaacaactcccgcttctgttggagtaaaaatccctcctcttaatcccacaataataatgataggtaataataaaggccaaaatgcttttttaaaagcaacccatctttctttgccagtttgttttctttctagacttgtatcattatttctatacaaaattttccaagtaacccataatccaacgaccattaataagcctggtacagttccccccataaataatttagtgatggatgctccagcagtaataccgtaaatgatcataggaatgcttggaggaataacaactgaaataatacctgcagcacaaattaatcctgtggaacgagcaccatcatattttttagaaatcatcataggaattagtattgcacctaacgcggccgtatccgctaccgcagaaccagataaccctgcaaatatcaacccagaaatgatcgcaacataacctaaaccacctttaatatgaccaaccatacttgttgcaaaattaatgattcgctcagaaattccaccatgcttcattatttctccagtaagcataaagaaaggaatagccatcaaaggaaaattattcgttcccatcacaaagttttctgtaattaattgcgtatcaaacatatcaagatgatatagcataatactcgcactcaacagcattgatagtgctacaggtacaccaagaaataacaataagaataaactacacaaaaataatagtaacattataagctcctatttatcagaggattctttataatctttaatcatgctaaacatgacaataaaaaagtaagatacggcagatataacagcagctaaatataaaaaagatgaagatatacctgtagctggcatttgttgagtataggtcaaagacatcagttgtaatgcaccataagctataaaaatcattgcaatcagaacgcatatatttgcaactattaagactatttttctatactgctcaggtaacgcagaaataataatttcaacagtaagatgagctttatccttggcaacaaggataatcccaaagaaaatcatatatacaaaacaaatcctagaaaactcttcagaaaatgcaattccagaatcaaagaagtacctcaagacagaattaaaaaacacgagagaaatcataataactaatgctaagatagaaagatattctaatgctttgtctaaatactttgctattttcataaaacaagctccttctttatcccccatgagcaatttataaaattgaacataggggatcttattaattatttagcttcgttaattttttggactacatccttagcccaatcatattttttataaaaactatcataaagcaccttagatgcattcaccatgtcatttttaaatgcttcacttggtacgataatttcatttccatgtttagctagataatctttaacttctaattctgttttaattgctaattcccactctttctcttgatacaatttagctgctttttcaaaaataatttgatcttcttttggaattttattccaagtttttaagctaatttgtaataatcctggagagaaaatatggttactttggataatatatttttgtacttcatataacccagagtctttaattaacatatacggattttcttgaccatcaattaccttttgttctaatgcagtaaaaacttcactgagcggcatgctttgtggatttatattcattgctttagcccaatcaacaaaaagtgaattcagcggaactcttaaacgtaaacctttaaaatcgtcaaatttctctaattttttattagatgaaataacacgaaatccattcataccataggcaagtaatttaattccatacttctccattttttgaccaattttatttgcgattggagattccaatacttttttagcctcttgattatccttaaataaataaggccattcccaaactccaaaaataggatctacattttgcaataataaacctgtaatacctgcttctatagtgccattacgtaatccatttacaatttgatcttcaccgccaagttgattattaggataaagtctaatctcatatctatgatttgtttcattttcaattgttttcttaaaatattcctgtaatgcaatatgtgatggatgtatatcagaattataatgtcctaacttaataattgtttttccaaatgcactgctactaaacaatatacttgaagcaagtaataatttacctaagcttttaattgacttcataactttctccttattgattatgttttttagaaaactgcattaatttttaaataattttctggatgatcagataaatcagaaataaaactaggaatttcttcaaatttgatacacttagtaatgatatgagatgcattaattttattagtagcaagcatatccaatgcctcctcaaattcccccttgcttgttctagaaccataaatattcaattctttaaaggtaattaaatttgttggtaatggagtttctgtttttggccatcctgttaaagcaattcttcctgcaaaggaggtataatgcagagtatttttgatagaaatattagcaccagatgcctccataacaacttctgccatacgaccacttgtaatttccttaattcttttaatgtcatcctccttatgcggatttacaatatgttcaattcccaaggattttgcatactcaagacgttgttctaatatatcaactaaaattgggattgctccatattgaaccgctgctaatgctgccattaatccaattgcaccagctccaataattactatgtgttcccctgattttaaagttgttctatgtaaagcatgtaaagctattgttaaaggttcagctaaaggtaattgatgaatcggtaggttatctgggactttagttaaaagatgagcgggatgtctaattacctcttgcatacctccatcaatatgaacaccaattacctttaatgattcacaacaattggttctaccaattgaacaaggatagcattgaccacaaaaaacataaggatcaacaattactcggtctccaaccctcaccctatccggcataccaattccactttcaattactctccctacaatttcatgcccaagtattcttggataagttactaatggattagttcctctatatgcaccaatatcagaaccacaaatccccattgattctacctgaataagtacatcattatcacttttctcgggataaggcacttctttaacaactacattgtttggtttttctaagcatattgctttgattcgctccttcatttttagactccttatatgccattgacagaataaaattacttgttatgtttaactatgatatgattatgaaacataaaaactctttttggaataccaaatatctatttttgtgagccgtatcacaaaaataaaaaattggaataccaatttaaggaaaaatatggaaaatatagtaaatagaacatatacccgaatcggtcaattgctaaaacaagatatttctcaaggaatttatagcattggagacaaactccctacagaacgagaaatttctgaaaaatttggtgtaagtagaactattgttagagaagcaatggttatgttagaagtagaaaaattagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaaatacttgtaataacataggagttaaaaatggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaaacgcaaaactgaaatagagaatgctggtttaagctggtcagtagtggaaagtgtaccagttcatgaagagattaaaactcagactggaaattatcaaaaatggattaataactataaacaaactcttcgcaatcttgctcaatgcggaattgacactgtttgttacaattttatgcctgttttagactggactcgtactgatctcgcttatgaattaccagatggttctaaagcattgcgctttgatcatatcgctttcgcagcatttgaacttcatattttaaaacgtcctgatgcagaaaaagcctataatcaagaagaacaagttgcagcaagaacctattatgacaagatgtcagagcaagatataacgcaattaacgcgtaatattattgcgggcttacccggtgcagaagaaggttatactcttgatgaatttcaaactcaattagatcgctataaagatatttcacccgaaaaattccgtacgcatttggcttattttttaaatgagatcgtacctgttgcccaagaagtaggaatcaaaatggcgattcatccagatgatcctccacgcccaatcttaggcttaccgcgcatagtttcaactattgaagatatgcaatggtttgtagaaactcaaccattaccagcaaatggttttacaatgtgtacgggttcttatggcgtacgctccgataatgatctcgtaaaaatgacagaacaatttgcagatcgtatttacttcgcacatttacgttctactcaacgtgaagataatccactaaccttccatgaagcagctcatctagaaggagacgtagatatgtttaatgtggtaaaagccttattaaatgaagaatatcgtcgattaaatcaaggagaaacgcgtttaatcccaatgcgcccagatcatgggcatcaaatgttggatgacttacgtaaaaaaaccaaccctggctactctgccattggtcggttaaaaggtctagctgaatttcgcggtttagagatggcactaaaaaaagtgtatttcaataagtaaaagaaaaagtgcggtcataaaaaacattatttttatcgaccgcacttccaatttattttatcaatcttctcattcgaatattgatcatttcgaccacaacagagaatcccattgcaaaatagatgtaacctttcgggatgtgaatatctaaactttctgcaattaaactaattccaactaaaaccaagaaggctaaagctagaattttcaaggttggatgcgtatctacgaaagcgccgattggttttgctgcaaacatcatcacgccaacggcaataataatcgccaaaatcatcacaggaaggtggcttgccatacctactgctgtaatcacagaatctaaagaaaaaacaatatctagcactgcaatttgaattaatacgccaaaataactcactttgtttttgctttcagaattatggtgttcttgatgatttattgcctctttaatttccccaaagctttttataatcaggaataaacctccgattaataaaatcaaatcacgcccagaaattgcttgattaaacagagtaaataatggtgcagtaagtttcataatccaagcaagtgacattaaaagtaaaattcttgtcagcattgctaaaccaagtccaataatacgaccagactggcgttggctttcaggtaaacgcccaactaggatactaataaaaataatattatcgacccctaaaatgatctccaaagcagtaagtgtcgcaagtgatacccaggcttcaggatcggtaatccattcaaacataatttttcctataatagagttaaatagatccgaaagttcggatcataatgactttatgatgaaaagcaatcgttatttacatttaagagataattgattaatcgtttttgagcgtttcaaaaatcgtttcagcaagtttaagggaaattcccggtacagaggctatttcatctaaggtcgcctttttcacaccttgtaaaccgccaagatatttcagtaaagcctgacgacgtttagcgcccacaccttcaatagtttctaaaccactttgtgtaaaggctttttgacgttttttacggtgtccgcttattgcgtgattatgactttcatcacggatgtgttgaatcaaatgcaatgccaaactatcatcaggcaaatgaatttcgcggtcttgtttgctgatgatcagtacttcctgcccagctcgacgatccacaccttttgccacgccaattaagtgcggtctatttttatcccattttacttgaagatgttggaacacgttcagcgcacgatttaattgcccttttccaccatcaataaaaataatatcaggaattttatcttcttctaaatcacgctcataacgtttctgcaacgcttgttccattgctgcataatcatccccaccagtaatgccttcaatattaaaacgacgataatcagatttcagtgggccttcttgattaaagacaacacaagatgctaccgtttgatttcccatcgtgtggcttatatcgaaacactccatacgcttaatttcagggagatttaacagatcacacaacgcttgataacgctctgacattcgtgaagattgtttaagttgtacatttaaagccgctttagcattaacttgtgcgagctgtaagtatttactcttatcgccttttacactttcttgaatcgtcacttttctgcctgcttgctccgtaagaagttgctcaagctctgatttttcagctaattgacgatcgacaataatactatttgggatacttcgcccttgatgaccttgtaaataaaattgccccacaaaagtttcggtaagttccgataaatccgtattggcagggacttttgggaaataactgcgattgcctagcacttttccttgacgaataaacatcacttgtacacaggctaaaccgtgttggtaagcgatggacataatatccatatcatctaaacgttcattggatacaaattgtttttcaataaccgaacgcaccgcctgaatttgatcgcgataacgagccgcctgttcaaaatctaaatttctgcttgcctgctccattttcccgattaaataatctaacacctgttgatctttgccttgtaaaaataaacgggctaattcaacttgttgattatattcttcatcggaaacatatccctgtacacaaggcgcagaacaacgcccaatttgatattgtaaacaaggacgagagcggttggaataaacggaattttcacattgtcgaacagggaaaagtttttgtaaaagcgataaggtttcacgcacggcgcctgcgtgaggataagggccgaaatattcacccgcaaattttttagacccacgataggacgtgattcttggatggcgttctttggttaataaaataaatggataggatttatcatcacgcaataatacgttatagcgaggctgataaagcttgataaaattatgctctagcagtaaagcttccgtttcagatgaagttagcatggtgtcaatatgatgaattgatgctaccaacgcctctgtttttttactactcagatttttacgaaaatagcttgaaagacgtttttttagatcctttgctttcccaacataaataacctgatctttatcgtcatacatacgataaacaccaggttcgtgagagacatccgctaagaactttttagcatcaaacattttaattcgccgctaaaattgcccgcactttttccaaatcttcagcagtatccacccccactgcaggcacttctttcgcaagctctacgtgaatgcgttcgccgttatataacacacgaagctgctcaagtttttctagattttcaagttgagtcggagcccattgcacatattgttttatgaaccccgcacgatatgcgtaaatgccaatatgacgtaagtaagcgtccgcaagctgtactttctgaacatcctgtaaattcataaactgatcacgatcgtaaggaataaccgaacgggaaaaatatagcacatagccgtctttatccgtcaaaactttcactgcatttggattgaataattcctcagcatcatgaatttttaccgcaagacttgccatattgacattaaattttgctaaattatctgccacttgtcgcacgataacgggaggaatcaaaggctcatcgccttgaatattgacaatgatttcattgtcaggaatcgctaatttttctacaacttccgctaaacgttctgtaccagaattatgattaaccgaagtcatgcacacttccgcgccaaaatttttggcaacatcagccacattttcattatcggtggcaataatcactcggttcgccccagactgcagcgctttctcaaatacatgttgaatcattggcttacctgcaatatcggcaagcggttttccaggtaaacgacttgatgcaaaacgagcggggataataacggtaaatgacataatttattccttattctttaatatttcagctttctcggtaagcaatcaaaacaactggagataaatcctttcagccatttctatattgcgccacaagtttgtctattttgtcccaaaagtgcggtaaattttcacattgtttttcagcctcaataatctctgcatctacagggacataccaccaattatcgttggcaaaagattggcattttacggcatctttttccgtcataaagagcggttgattttcagcaagtttttctaattgagaggcttcaaaatgttgatgatcttgaaatgcttgagttcgttctaattgaatccctaacttttctaacatagtaaaaaaacgctgtggattgccaatccctgcaatggcaacaccagattgaaattcctttaattggcgtttttcattggtttttaaattaattgcgaaatggggtacaagatacataactgcatctgaatactgattttttccaccattagtgatcacaaaatctacggattttaatcgacttggtaattcacgcaatgggcctgcaggcaatacaaaaccatttcccaatgcgcgctcagcgtccattacgacaatttccaaatcacgctgtaatttataatgctgtaaaccatcgtcagaaacaataatatcgcactctgcttggcttaagagtaattcaatcgcttgctggcgattcggggaaatcacgactggcgcattggtgcgtttagcgatcaatactggctcatcgccaccttcaatcggacgcgtattttcagtgacgaataacggataagttttagatttactgccgtaaccacgagaaatcacacctacgcgcaaacctcgtttttttaattcttccacaagccacaccaccacgggcgttttgccatttccaccaacagacaaatttcccacaattatcactggttttggtgcgcgataagaagattttatccccaaacaaaataaggcgtgacgcagttggctaatcaaccaaaacaataaagaaaaaggcgataagagccaaataagtttggaattggaataccagaagggcatagaaaatcctttctaataagtgcggataaaataacgcgagtttttcaactcgcgttttcaataattaataaattagccactaaactgcatactgtatagctgtttataagcaccattttgttcaagcaatgctttatggttgcctcgctcacgaatttctccgtgatcaatcacaagaatttcatccgcattttcaatggttgataaacgatgggcgattacgataacagtacgatctttcttcaattcatctaatgcagattgaatggcgcgttctgattccgtatctagtgcagatgtagcttcatctaaaattaatactggcgaattacgcaataaagcgcgagcaatcgctaaacgctggcgttgcccaccagataggctcgcaccattttcgccaattaccgtatcaaaaccttgcggtaatttttcgataaactctaaagcataagccgcttttgctgcagcaataatttcttcgcgagaatacttatcctgcgcggcataagcaatattattcgcaatggtatcgttaaataaatgaacttgttgagaaaccacagcacagttctcacgcaaattagataaacgataatcttggatatttacgccatccagtaaaatctcgccttgctcaatatcgtaaaaacgtgtcactaaattagcaatggttgatttgcccgatccagaacgtcccactaaagcaacggtttttcctgcaggcacgctaaaagaaatattatttaatgcaagttcctcttttccctgatatgcaaaactcacatttttaaattctaacgcacctttcgcaggttctgctttataagtgccgttatctttttctggttctaaatctaaaatggcaaatagcgtttgacatgctgccattccacgttggaattgagagtttacattcgttaaggattttaatgggcgcatcattgccaacatagatgaaaaaactaccgtaaaagaacccgcacttagattatcttccgcaattaatggcgtggtagctaaaaacaatacagcaactaaagcaagagaagcaataatctgcacaacagggtcggaaatggaatctgcagtaaccattttcatacctttacgacgcatgttgttactcactttattaaaacgctcttcctcgacaaactgaccaccaaaagaaatcacgactttatgtcctttcagcatttgctccgtcgtcgccgtcaattcccccattgaatcttgtaaatttttactcaacttacggaaaatttttgaaacgatagtgatcaacactgcaataattggtccgataacaaataaaacaagggttaattcccagcttgtataaaacatcactgccaatagcgaaataatatatgctccttctcgcacaatggtaatcaaagatcctgaagaagaacttgcaatcatctcagaatcataagtgatacgagaaagtaatttccccgttgaatttctgtcaaagaaactcactggcataaacattaaatgtttaaataaacggcgacgcattgtcatgacaactttgcctgatacccacgccaagcaataattagaaataaagttagtcacgccacgtaaaataatcattcccacaacaacaaaagccattattttcaaaaatgaatggtttgccttgccaaaaccatcgtccaacaacggttttaacaaataaatcaagcctgaatcagccaatgcattaaaaactaacgcaatacctgaagcaataagccctgctttaaaaggtttaatcattggccacaaacgtttaaaagtttgtaaggttgaaaaatcattttcttgtaatttttgctcttgcataatcgctatctaatagtaaaaattgcacgcattgtaccttttattcctttgataatccaattacacgcgcataccaaggggaaaattttgtgcgagcttgctggatttctaatcggtcttgaaaaaaatttacccgcacttgccccgaaacagcggtattttctaccgcacttttatagcgatgaagcctttccataaccgaataatgagggaatttccacggattccaacgcccactagaaataatcgctacatctggtctaacctgagaaagcaagtattcacttgtcgatgttttactcccatgatgccccacttgcaacacatcgattttgcctaaagtgcgggcaaaaatttgctcattttttgcttcagcatcgccagttagcaaaacgctattctttccatcatcgactaaaatcacacaagaatggggattatcagctcgtgtcgcaacgttgtgaggagaaagtatttgaaaatgcaacccttgccaatgccaatcacgcccagcagtacaaaaagtgcggtaattttccccatagtttttccgtgaaggggtaatcaattccacattgggatacgcctttaaaattgtcgaagcaccacctgcgtgatcgttatcgtcgtggcttaaaatcaatttttccaaaacaatcccttctctttgtaaataaggcaaaatttccaactcagccatacttccacctcgccaagaagaacccgtatcataaagaatccctttgccatttttcacaatcagcgttgccaagccctgccccacatctaaagtatctacctgccaagttggcttgctcaattgtttaaacaacaaaatcataaaacacataagaataatgccgaaagaacatcgcaaaacgttgattcgatcagtttttagcaaaggtttactgagattcaatgtaaaaaatcttggtcgtttaattttccaagttgatgatgaaacctctggttctcgataaatactccaaataattaacataaaaattcctgcacaaagtgcggttaaaaccaatgctaaattaaatgaaacattaaaccaattcccttgaaaaacagaaattaacccagtaattccttcggctaacttgtttgctagttgccaagaaaacattgtgccgttagtaaaaacggcaaataaaattaatggcacaagcaaaaaactataaattggaaccgccataagattggctaaaaatccacttaacgataagccattaaatagaaaaagttgcaaaggcgtaaaaaagagcaataacccaaattgcaaatgaaataaactaaaaatccaccgcacttttggagaaaaagggcgatttttccattgaaaaagtgaaaaaggcacataacgataccagaggagcaaacacccaaccgctccacaagaaagccaaaaactgaccgaaagcggcattaatggatcgcagaaaagcaagaatccgacaaccaacgtaaaaagctgaatgggcgaataatgtcgcctcattatttgaataaataaaacgaaaacaagtgctgaaatggcacgaaaagttggcacactaaaaccagccaaatacgcataaattaaagcaaataaaacaccaaaaactaaaggaaaataaggatgaataaaacgggtggggcaaaagacttgcacaacacgcgccaagcaaaatccaattcccatagccaacccaatatgtaagccagaaatagcaataagatgcgcagtattggtttgttggtaaattgaccaagtggttttatctaaccaagcccgttcgccaaaagctaaggcaatcaataaaccttgtaaggacaacccttctgtttgtttttttacttgttgcaatttttctgcacgcaatgatgaaacatccgcaattttcaccgcactttttaccgttccaacagccgtaattccttttgaaaaataccattgttgccgatcaaacccaccaaaatttaatcgcgcagaaaggggacgtaaagaaatttcagcttgccaaatttccgataattgaggcacctctttcgctttccaatttaagaaaattcgttgttcttgcaaattattctccaatgttgctgtggcgataagcgtttgataatcctgttggtgcaaaatttcttgaatcttaaaagttaccacttgattttgagcggtaatattttgagcttgttgtgataaactcaaagccgaataatgaaaatagccaagagaggcaacaaaaaaagcaaggctaactaagaaatttctacgcaagaaaataaaaagaaaaatcaaaacaagcgcaataacgagagcaacttgccaaggcaatagcaacggttgcggtagaaataacaacgttaaatccgcgacaattaacaagacagctaaagttattaagtttaatttcatttttataaaaaattaattccagtctctctaagactaggctagttttatttaaatatgcaaacggttgcttcaaattttgcgatccatatcgtaaaaataaatttttcaggaaaatttacttgctaaaacaaacaacttctgatatttataccgcccgcaaaaattgggttcctaaaatagcagtcaggaacaaactaaaataacaagacaggaagtcgtgaagtccacgcttaattctgtatgtattaggagtgagagatgtcaaaagcatcattgagcttgctagatttagcaggcgttaagccttatcaaatgaaaaaagatgaagaatatatgaatgaagagcaaattcttcatttcagaaaaattcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaattcattctattgaaaaatacaaaagtgcggttaaaattagccgcacttttttgcatttaaaaatgcaggaaaatccacttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattctaaacgagttgagcgttctaatagccaaatgccaaaagcgcgagcaaaaaaatcggaacaaacacgtcgctatgataaaaatgtgattaaagcggctcaatttgatatttctccgagtgattttagccgtaatgctctcaatgtagtggaaaaactgcaacgtcaaggtttcgaggcttatatcgtcggtggatgtatccgtgatttattgctcggtaaaaaaccaaaagattttgatgttgcaacaaatgctcgcccagagcaaatccaaaacatttttcaacgccaatgtcgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaggatctcaaagcaggcaagctacgcttaattggcgatcctgttacacgttatcaagaagatcctgtgcgcatgctacgctcaattcgttttatggcaaaacttgatatgttccttgaaaaaccaagtgaacagccaattcgtgaacttgcacctttattaaaaaatattccaccagctcgcttatttgacgaaagtttaaaattattgcaggcaggacaaggggtaaaaacctatcggttattacgccaatatagtttatttgaacaacttttccctgcattaagcgcatattttacagagaaagaagatagctttgcagaacgtatgatcgttaccgcccttagttcgacagatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgtgctttggctgcaccacgtcgtcatactgcggtcattcgtgacatttggttcttacaattgcaattattaaaacgtactggctcagcaccaatgcgtaccatggaacatccaaaattccgtgctggctttgatttactggctatgcgtgcagaaattgaaggtggcgaaaccattgaattagccaaatggtggcacgaatatcaatttagtaatggtgaacagcgcgaacagttgatacacgagcaacaacgcttacatcctaaaccaaagaaaaaatactaccgtccacgccgtcgtaaaataacacgttcagcagagtaaggggagatatgattactgcatatattgctctaggtagcaatttaaacacaccagtagaacaattacatgctgcgcttaaagcgataagtcagttaccaaacacgcatttagtaacgacgagctctttttataaaagcaaaccgctcggcccacaagatcaacccgattatgtgaatgccgttgcaaaaattgaaaccgaacttagtccgctcaagctattagatgaattacaacgtattgaaaacgagcaaggtcgagtgcgtttacgtcgctggggcgaacgcacgttagatttagatattttgctctacggcaatgaaattattcaaaacgaacgcttaataattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctagaaatttcaccgcacttttatgaacctcaaaagtgcggtagaatcagcccacatttttcttcattcatgacccgttatggaaagcttaactcaatatatccctgatgaattttctatgcttcgcttcggcaaaaaattcgcagaaattcttttaaaattgcataccgaaaaagcaattatggtttatcttaacggtgatcttggggcaggaaaaacaacgctaacgcgcggaatgttgcaaggcatcggtcatcaaggtaatgtaaaaagcccaacttatacgctggttgaagaatacaatattgcaggcaaaatgatttatcattttgatttatatcgtctagcagatcctgaagagctcgaatttatgggcattagagattattttaatacagatagcatctgcttaattgaatggtcagaaaaaggtcaaggcatattgccagaagctgatattttagtgaatattgattattacgatgatgcacgaaatattgaattaatcgcacaaacaaatttgggtaaaaatattataagcgcattttctaattaacttatttatgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataaatgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttagcacgacatgctacgagtaaaatagccgatcttgacgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaaccagcatcacatcctgtcggcacaacagttgaagttgccaatctttttttcaacacgccagcccgccgaaaatttttgcgcacagataaaacagaatttgctcatattgatgaagtcattcgtcgcattgctttaacaaaattcaatacggcatttacattaacgcataatgggaaaattatccgtcaataccgtcctgccgaagcaatcaatcaacaactaaaacgtgtcgccgcgatttgtggggatgattttgtcaaaaatgccttacgaattgattggaaacacgatgatttacatttatcaggttgggtggcgacaccaaattttagccgaactcaaaatgatttaagttattgctatattaatggccgaatggttcgagataaagtgatcagccatgcgattcgacaagcctatgctcaatatttaccaaccgatgcttatcctgcgtttgtgttgtttattgatttaaacccgcacgatgtagatgtcaatgttcatccaaccaaacatgaagtacgctttcatcaacaacgcctcattcatgattttatttacgaaggcataagttatgcactaaacaatcaagaacagcttaattggcacacagaccaaagtgcggtagaaaatcacgaagaaaatacagtgcgtgagccccaaccgaattatagcattcgtcctaatcgtgcagctgcggggcaaaatagctttgcgccaaaatattatgaaaaaccacagcaaaatcaaccgcacttttctaacacaccagtgttgccaaatcatgtaagtactggttatcgagattaccgttctgatgcaccgagtaaaactgagcaacgtttatatgctgaattgttacgcacgttaccgcctacagcgcaaaaggatatatcggatacagcacaacaaaatatttcagatacagctaaaatcatctcaactgaaataattgagtgctcatcacatctgcgtaccctttcacttattgaaaatcgcgcgctcttattacaacagaaccaagatttctttttgctttcattggaaaaattacaacgcttgcaatggcaattggctttacaacaaatacagattgaacaacaaccattgttgattccaatcgtatttcgtttaacagaggcacaatttcaagcatggcaacaatattcagataacttcaaaaaaattggctttgaatttatcgaaaatcaagcacaattacgcttaaccttaaataaagtgccaaatgtgttacgcacacaaaatctacaaaaatgcctgatggcaatgctgactagagatgaaaattcatcaccatttttaaccgcactttgcgcacaattagaatgtaaaacctttgacgctttagcggacgcactcaatttattaagcgatacagaacgtttactcacgcaaacgaatcgcacggcattcacccaattactcaaacctgttaattggcagcctttattagacgaaatttagattcttcatgaaaccaaccgcaatttttttaatgggccctacggcctcaggcaaaacggatttagctattcaactacgaagctcgcttccagttgaagtgattagtgtagattcagcgctcatttataaaggaatggatattggcacagcgaaaccatcaaaagaagaacttgctcttgcgcctcaccgtttgattgatattttagatccatcagaaagctattccgcaatgaatttccgcgatgatgcgctacgcgaaatggcggatattaccgcacaaggcaaaatcccgttactagtgggtggtacgatgttgtattacaaagccttaattgaagggctttctcccttgccttctgctgatgaaaatattcgtgccgagcttgaacaaaaagcagctcaacaaggttgggcagcattgcatacagaactcgccaaaatcgatcccatttctgccgcccgaattaatcccagtgattctcaacgaatcaatcgtgctttagaggttttttatatcacgggaaaatcactcacagagctgactgaagaaaaaggcgaagccttgccttatgattttgtgcaatttgcaattgcgccgcaagatcgccatgttttgcatgaacgcatcgaacaacgctttcataaaatgattgaactaggctttcaagcagaagtggaaaaactttatgcacgtggcgatttaaatattaatctgccgtcaattcgctgtgtaggctaccgtcagatgtgggaatatttgcaaggcgattacgatcacgaggaaatgattttccgtggtatttgtgcaacgcgccaacttgcaaaacgccagctcacttggctgcgcggctggaaaacaccaatacaatggctagatagtttgcaacctcaacaagcgaaagaaaccgtattacgtcacttagattcctatcaaaaaggttagaaaaaatgaccgcactttctgccctcattgaacaaaaattacaatctcttggcacaatcctgtgccaatcttttccagagctttccccagaaaaaattcacgaagctattcaacaaaattcaaatcatccagaactgcctgtttatcaattaggctatgccatagcaatgtctgactttgtggaaaaagtcttgcaaaaatacccgcacttagtgaaacaatggtgggaaaaatccccctgttttgcagattgcactgcctatattgaacgtttgaatagagagttagccaatgtacatgacgaaactgcactctatcaaacattacgtcaattccgtaacattgaaatggcaaaattaagtttttgtcaaagtttgaatcttgcgactgttgaggaaatttttgttcagctttcacaacttgcagagagtttaattatcgctgcccgcgattggctttatcatcaagcctgtgcggagataggcacaccaatggatgaacaaggcaatccgcagcagctttatatcctaggaatggggaaactaggcggctttgaactaaatttttcctcggatattgatttaattttcacttatccatcacaaggggaaacatctattgaaaatacgaatgctcgacgttctgtggataatggaaaattttttacacgtttagggcaacgccttatttctgccttagatgaatttacctctgatggttttgtgtatcgaaccgatatgcgcttgcgcccatttggtgacagcggcgcgcttgttctcagctttgcagcaatggaacaatattatcaagatcaaggtcgagattgggaacgctatgcaatgattaaagggcgagtattgggcgtacaaacaaaggatcccaacgtatctaaattgcaaaaaatgttacgcccctttgtgtatcgtcgctatattgactttagtgtgattcaatctttacgtgaaatgaaaggcaaaattgagcgagaagtacgccgtcgtggtttgaaagataatattaaactaggtgctggtggtattcgtgaagtcgaatttatcgtacaagtttttcaactcattcgaggcgggcgagaaatcaatctgcaacaacattcactcttaaagatcttgcctgaaattaccaaactaggattaattaccgaacaacaattccacgatttacgtgaaagttatatttttttacgccgcgtagaaaacattctacaagccattaacgatcaacaaacgcaaacactaccaaccgatgaaatagatcaaattcgtttagtcaaggcatgtaaaactttcacctgtttaaatgaaaataatcaaaccattgaaaaacattatccaatagaaaattgggacgatttttaccgcactttacaacaaaaacaagaaaaagtgcgggcagtatttactcaattaatcggtgatgaacaagatgagccttcacaaactgatagccaatggcaagattttttagaagcagattttgaggatattgaacaaacattattagagagtggtgtatcagaaaataatattgatgaagttttagaaaagcttgctcaattcaaagacggcctaaatcacagagtgattgggtcgcgtgggcgtgatgttttgagtcatttgatgccaacagtacttgcactcatttttgaacaagaaaattaccgcactttgctcccccgaatactgaacattattgaaaaaatttcgagtcgcacgacttatttagaattattattggaaaatcctcgcgcacttcagcaagttattgaactttgtgcacagtctcaacttatttcagaacaattggctcgctatcctattttattagatgaattgcttaatacggaagcactacgtcatccattgccatttacccaatatcctgcagagttacaccaatatttgcttcgtttaccccctgatgatgaagaacagattatcgatgctttacgtcaatttaaacaagcaaccctattaaaagtggcagcggcagatattttaggcgcattaccagtaatgaaagtaagcgatcatttaacctatcttgctgaatccattattgaagtggttgtgaatctagcttggaaacaagtgtcttctagatttggcgtgcctgaacatttacaaaataatgaaaaaggatttttagttattggttatggaaaacttggtggtattgaactcggttataaatccgatttagacctcgtatttttgtacgatgccgtagaaaatcaaacaacaggtggcaagaaagtgattgatagcaatcaattttacctacgcttggcacaaaagattgtgagtattttcagcataaatacttccgctggcgtactttatgaggcagatatgcgcctgcgcccttctggcgatgctggcttaattggctgctctctttctgcattttcccattatcaattgaatgacgcttggacatgggaaaaacaagcacttgtgcgcgctcgtccagtatttggcgaatcatctcttaaagctaaatttgagcatatccgccaacaagtgctttctgcatcacgagatattgaacaattaaaacaagatgttgttgagatgcggaaaaaaatgtttgcccatttatctcactcaaaacacagtgaatttaaccttaaaacagatcgcggtggcattacagatatagaatttattgctcaatatttaatgcttgccaatgccccgaaaaaaccacaactaacaaaatggtcagacaatgttcgtattttcgatgatatagcagaggctaaaattattagccaaacagactgcgacacattaaaacaatgttatgttgatttacgcaatgctattcaccatttaaatttgataggcaaatcccccgttgtggatgaaactgaatttgtcaaagagcggtcatttattcaagcattttgggataggttatttgtatcctaaaatatggcttgtggacgtttcaaaaatagccttcatcacaaatcttcttgaaacctcgcaaaaactaaatattcaatcctatttttaatgaaccaaatctaacatttcctgtgcattggctagagctaattctgtgatttcacttccgcccaagagtcttgccaaggctggtacacgttcagcttgtgaaagtgcggtcatttttgtttcagttttattatcaacagtaaatttttctacattgaactgatgatggccatgacaagcaacctgtggcaagtgcgttacgcataatacttggcagcgttcacttaattgacgtaaaagttttccgacaacacttgctgtttttccgctaatgcccacgtccacttcatcgaaaattaacgttggaatagccgattgatcagaagttaaaacttgaatcgctaaagaaatacgagaaagctcaccaccagaggcaattttagctaatggctgcggttgttgtcctaaattactacgcaaagtgaaaatcacattatccgcaccatttgcactcactttatctaaatccgtattcaactctacataaaattcagcgttttccattgcaagttgttttatcgactgtgtgacattttgcgctaagcgggttgcagattgctgacgacttgctgttaatgctgtagccgttgcttgcatttgttcaaatgctcgtttttcttgctcaatcaacatctcttcactttcagaaaaatccaaaagtgcggttaattccgcttttaattttttgtgctgttctacaagatcttcaggtttaacttgatgtttacgagcaagttgtaaagcctgactaattcgctgttcgatttcctgtaaaagttgaggatcctgctcgatattacttgataaattttgcacttcactggttgcttcttgcacttgaatcaacgcatcattcaacatattttgcacttcagcatattgcggatcaagttcagctaattcatcaatatattgtgtcgcacgataaagcaaactatcgatatttacggtgtcattttcacttaaaatttgcagggccgattgagaaagttgggttagctgttcgctgctagataaacgacgttgttcatcttctaattccaaatattcatttggtcgaaggttaaattcatctaactcatccacttgatactgtaaaagttgtttacgtgcttcattttccgccactttttgttgaaaggttttaacttgattttgaagatttttccatgtctgataatcttcacgcattttcacaagtaattcaggatgagcggcaaaattatcaactaactgaagctgatagtcattttttaacaataattgagaagcgtgttgcccattaatatgaacgagatattgagcaatttcttttaattgagaagcggatactggtgtactattaataaaagccttagaacgtccgtctgcattaattatacgacgtaaaatacattcagttggattatctggatcctgtaattcttgctcactcaaccagtgataagcaggattttgcgattctagttggaaagttgcacaaatttccgcacgctcttgcccttcacgcaccattgaggtttctactctttgtccgaaacataaacctaaagcatcaatggcgatagattttccagcaccagtttcccctgttataacagacattcctttcgccaattcaatatcaagctgacgaacaatcgcaaaattattgatagtaagttgagtaagcatagcaaaatcctttaactgtatatttaatatgatataactgatttaatttacagtaaaggattttttacagtattttgtcaaatctatttcaatcgaaaatttttaccataatcaaaatgattttaaccaacctaatttgctacttaacacattgtaataattataatttttcagatgaagcaatcggagtttatgctcgcttttttgaatatgcaccacatcatctggggtaaaaggtaaggtaatttgactatcacagcccacttctaattgagaggtattatgttcagcaaaacgaatcgatattttactatccccatcaacaacaagagggcgagaagttaatttatgtggaaacattggcactaatgcaatggcattaaggtttggtgtcaaaataggtccaccagcggaaagagaataagccgtagaacctgttggagtagaaacaattaatccatcagaacgttgagaaaatgcaaacttatcattgatatatacgtgaaagtcaatcatatgtgcaattttggcgggatgaataaccgcttcatttaccgcattgctggttgatacgatttcacttgctcgttcgatttttgcttccaataaaaaacgttcttccacaaaaaattcgccacgttctaaacaagcttcaagctgggaataggcatttttcgggtcaatatccgttaaaaatcccaaattaccacgattaataccaatcaatggaatatcatattttgctaatacccgagcgcgccctagcatattgccgtctccaccaatcacaatggctaattgggctcggtggcctatttcttctaacgtagcaagatgttcaaaaggtaactcaagtgttatggcgacttctttttccaccaacacttgataaccacgttccattaaccaatgaaataagtttttgtgcatttgtaagttaatatcattgcgaggcttacctacaagagcaatggttttaaaggaacgatataaatgattcataaaatgaccgcacttgaatttaacattttcgtcattatatcgttttttgctacactatgcccaattacgattaatcaattttgttttacggagaaaaaaatgtcagaacaagaacaaaaagttgaaatcccagaagtagaaaatcaagaagaagtcgttgtggaagaagcacaacaagcagatccttctcaagaatttgatcctttagaagaagcaattgctcgcgtgcaagagcttgaagagcagctaaaaactcaaatagaagaagcggcaaacaaagaacaggatattttacttcgctctcgtgctgaaattgaaaatcttcgtcgtcgtactgaacaagacgtagaaaaagcacataaattcgctttggaaaaattttcaaaagacattttgaatactatcgataacctagagcgtgcgcttgccactccagcaaataaagaagatgaaagcgtaaaagccttatttgacggtgtagaactaaccttaaaagaattagtttcaaccgttgggcgttttggcgtggaagctgtgggagttgtcggtgaagcctttaatcctgatttacatcaagccatttcaatgcaaccagctgaaggctttgaaaccaatcaaattagcgtcgtattgcaaaaaggctacaccttaagtggtcgagtcattcgcccagcgatggtaatggtggcggcttaatttatattttgtctaaagagcggtcggtttttcgaccgttttttctttttcctgaataacaacataaactttacggataatttccctaaaatcttcgctcgttgtagcccaatctagaagatctacgcgccacggtaaatctgattcagaaaaagcttcctttaatctgtcacgagctaaaaaatctaaaggctcctcagagataatcgcaaggtcaagatcggaatatttttttgcttttccctttacacgagaaccgaaagcccatacggtataatcaggtacgaattgttgtaaaatagttttcacaatcgccaattcttcagattttatatcaagctgtgcaaaactagtcatattgatttctctgacgtaattgttccaataggaaacaactttctattaaaaaatcatcaattggtgcataaacagccatggctttttcctgatcataagtatgtgatgtaatattacgcatatcacgataaacaacccattttgacatatcttcaatcaaaccaaatctcaatgcttctcgcaaaatatccttaaatccataagccccaatatcatcggtattaattgcatcttgttgaagttggcgtttcatcatttttaaacttaactcataaacaaattcaaatttctgaattgcacctgcaattaaggtatcttgtacaatagagggttgcatatcaaaccaatttctgtctgaaatttgtactacggtttgctctaacgaataaaatgcagcgtctaatacatttaaatttagcttatcagtcatcatttttacctctgttaaatactcatctattttaccatagactattttttctcaaaacctataaccccaaaagtaaacattgtgatattgatcacaaaatcaaaaatatttgagaaaagctctcaacaacttaatgtgatatttttctaataaaatcaatctttaacaaaattatcttacgacaaaaaggtctaaaacactacatattgtgtgttgattatctttttagatctatatatagtgcaatccgcatttcaaaaacactatatattggagctatatcatgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttccccttatgtgcaaatcagttacgaaaaacatctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggttttggtttaggtacaagctggcaatcccgcttaattcagcaagctattttaaaaaatcggattcgtggactcggaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccaaaaacgaagaagatttctaccgcactttagatgaacgtttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctttgatttaactccctagcaaaagcacgcattttttaatgcgtgctttttgttaccaactttggcattccccaaaatctccgctaaaataaccgcactttttcttatcttctaggaaagcaatatgtcagatattctcaataacctcattcatcttcttaaacttgaaaaaattgatgatttaatctttcgtggtgaaagccaagatttaggttttcgtcaagtatttggcgggcaagtagtggcacaggcgttatctgcagcaatgcaggtggcgccagaagatcgcattttacattcttgtcatgcctattttcttgccccaggagacagccaatatccgattatttacgatgtggaaaccttgcgtgaagggcgtaatttttctgcattacgcgtaaaagccattcaacataaaaataccatttgtcatgtaaccacttctttccaagtgctggaaaaaggttttgaacatcaaaattcaatgccaaatgttggcgcgcctgaagactttacagatgaaaatgtgatgctacaaaaagtggctcaaaccttgccagaaccactcaatgaaaaatttgcggcagagcgtccatttgaggtacgtaccaaatatttgaataacccatttaacgggacaaaattgccagccgagcaatattcttggtttaaaaccaatggtgaaacgccgcttgatataaaaattcagcaatgtttattggcttatttttccgattttcactgtattttgaccgcacttcatccgcacgaaaaaggctttttacaaaaaggaatgaaagtggcaaccattgatcatagtatttggttccatcgtccgtttgatttaaatcactggcatttgcacgcaattgaaagcaataatgcttttggagggcgaggcttagctcgcgggcaaattttctcgcaagatggtcaattaatcgcgacaacacaacaagaaggtttgatccgttttaatgaataagagagaaaaaatgaccgcacttattacacaattttggcaacaggttgaaaccgagcaaaccttgaaatcttatattaagaaatgatgaaaaaataaaaagactaagttctattacattctgaacttagtctttttaatgaaattaatttaacgtttaaatttattgcttacgccaagttgttccattcggcccatcttctaatacgatgcccatagcgataagctcattacgcgcagcatcagcagtagcccaatctttagcagcgcgggcctcattgcgttgtttaatcagtgcttcaatttttgccacttcatcatcgtcagaacctgcttgtaagaatttttctggatcttgttgaagtaatcctaaaatcgcccccaattcacgcaaacgcgcggcaagtccattggctttctcagcatcctctgtttttaacttgttaatttcacgcgccatttcgaataaaacagaaagtgcatttggcgtattaaaatcatcgtccattgcttcacggaaggtttccacaaaattttctccgccaaaaacaaccgcactttgatccgttccacgtaaagccgtgtataaacgttccaacgcaccttgcgctaaattcaagttttcttcgctgtaatttagctggctacgataatgtgccgttaataagaaataacgtacagcttctgcattgtaatggtttaatacatcacgaattgtgaagaaattgccgagagatttcgacattttttctttatccaccataatcatgccagaatggatccaataattcacatattggccaccatgcgcacagcaagattgtgcaatttcattttcgtggtgtgggaacattaaatcagagccaccaccgtgaatatcaaaatgttcgccaagctgtttgcagttcatagccgaacattcaatatgccagccaggacgacctgcaccccaaggggaagcccaacttggttcgttttctttcgacattttccaaagcacgaaatccattggatttttcttgatttcattgatttcaatacgtgcaccagcttgtaattgctcaagatcttgacgggataatttgccgtattctttgaagctttctacatcaaacatcacatcgccattatctgcaacataagcatgtccacgtttaatcaatttttccacaatttcaataatttcaggaatatgatgggttgcgcgaggctcaaaatcagggcgtaatacattaagtgcatcaaaatctttatacatttcctgcaccatacgatccactagctgatcgcaggtttctttgttttctaatgcacgtttgatgattttgtcatctacgtccgtaatattgcgcacataagttaaatcgtaacccaaagaacgtaaataacgggcaatcacatcaaaacacacaaaagtgcgtccatgaccgatatggcacaaatcataaacagtgacgccacaaacatacattcccactttattttcgtggataggtttaaagatttctttttctctcgttaaggtattgaaaatttttagcatttttaagctcgtaaaatgaaataaaaacaaaccgcacttttatagcacttttacctcgattgtggaataatacgacccttaattttttagagggaaaacaaaatggttacattacacacaaattttggcgacattaaaattaaattggattttgataaagctccagttacagcagaaaatttcttaaattactgcaaagaaggtttttataataacacaatttttcatcgtgttattgatggctttatgattcaaggtggcggtatggaaagcggtatgcatgaaaaagcaaccaaagcaccaatccaaaatgaagcgaacaatcgtttaagcaacaaacgtggaaccattgcaatggcacgcacgtcagatccacattcagcgaccgcacaatttttcattaacgtggcagacaatgatttcttaaattatcgttcaaaagaaatgtttggtcgagaagtcgttcaagaatggggctatgcggtatttggtgaagtggttgaagggatggatgttgttgataaaatcaaaaaagtgaaaacaggcaacaaaggctttcatcaagatgttcctactgaagatgtagtgattacattggtttctattgagtaacaaatgagcataaaacaacatcgccctaaagttggagaaattctagaatgtgattatggtcaattttcgcatacctgtcacgttgatggacatattccacctgaaatggttaaaaaacgtttagttgttgttttgaatgcgaaactgaacgggcttattttagttgcaccaatttcatctacaattaatttagatggtataaaaaatggctatcatattgaaatagattcagaattaataaaagcaacaagcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtagatagaatacagtatagacttccgagcgtaacgccttagagcgatcatcatcgaaagatgagtttttaaacgccattgagcgatgaatcccctgattagcgataatcaggggattttttatagaatttagataaagatatttatgcacttcttcgacactcacacgcatcttgattatctccaacaatttactggggaaccgttgtcacaacttattgataatgctaagcaagccgatgtgcaaaaaatactggttgtggcggtgaaagaagctgattttaaaacaatccaaaatatgaccgcactttttcctgataatttgtgctatgggcttgggctccatcctctttatattcaagaacacgccgaaaatgatttgattctgttagaacaagccttaaaaaatcgtgatgcaaattgcacggcagtggcagaaattggtttagaacgcgcaattcctgatttgctcaccgatgaactttgggcaaagcaatgtcatttttttgaaagccaactttatttggcaaagcaatttaatttacccgtcaatattcacagtcgaaaaactcatgatcaaatttttacttttttaaaacgtattccattatctaaacttggcgtggtacacggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagtccagatatgcctgtatttggttttcaaggccaacctaatcgaccagaacgtattgtggaaagttttaaagccctttgcaccttaagaaatgaacctgctgaattgattaaaaaacttacatggaaaaatgcttgccagattttttcttgatccacgtcacattactgaaattattttgaattaaattgcagtcttcaatggcttaaaatccatggtcacatcgggcaattatgcctcttattatttagcgcttttgccttccgaaaatggcgaaactattgataactgggtgcttccacttggtactcaaggcttaacttttgaagctgatagctggaatagcttaggtatgcgtagcaatgtttcttgctttatgcgcatgaccgatatgccattagatcgtagctggcgtgtagcgtggaactctcccctaattacatgtatgccgtggcaactggagcaaagatgaaagcgtattattgcgcgggccttatacatcattagtggatttatttgaatcggcattacctgatattttaatgctcgaattttctacgccaagagcgggagaattaagttcgttattagaaagtgaaatattaagacaaaaatgtattttaggcttaggcgtcatcaatcctcgttctgatgaagtggaaactgtaacacaaattgttcagcgcgcagaaaaagccttaaattaccttccaccagagcaaatatcaaaatttcagacaaaaaaattgccccattaaggggcaatcttatcaacgctctaaagttacttatagctttaagcaacgattaaatatgttggttaatgaagttagccaattgagtttttggtaatgcaccaacttgagttgcaacaacttgaccatttttaatcaataataatgttgggatactacgaacaccaaattgtgctggcgttgcttggttgtcatccacattcattttcacaattttaactttacctgcaaattcaggtgcaagttcatctaacactggtgcaatcattttgcaaggaccacaccaaggtgcccaaaagtctaataaaacggggatatctgaattaactacaacactttcaaaatctgcgtcattaatgtgtaatacttcgctcattttgttttccttattttgtgaatggattccctatataagggctttttttaaacttacaagtgcggtgcagaataacaccgttttaaaaaatgtaaactaatcgttttaattgccaaaagctaagacggcaaaacaatattttcacacactttacccgatttcaatttataaacatttgataaagtcacatccgcaatattggttagtgcttcttcggttaaaaatgcttggtggcctgttagcaatacattatggcaagaagataaacggcggaaaatatcatcttgaatgacttcgttagacttatcttcaaagaacaaatctcgttcattctcatacacatccatacctaacgccccgattttacgctgttttaacgcatcaattgcagcctgagtatcaatcaaagagccacgactcgtattaacgatcatcacaccatctttcatttttgcaaaagcctcgcgatttaataaatgatagttttctggcgttgctgggcaatgaagcgtaatgacatgagatttagcataaagctcatctaattcaacatattgtccaccaagctcttccaccagtggatttttaaaaggatcgtacgccaaaatattcatgccaaaacctttcaaaattcgcatcactgcgatcccgatttttcctgttccgattacgccgactgtgcgtccgtacatattgaaaccaattaacccctcaagagagaaattcgcttctcgggtacgctgataagcacgatgaattcgacggttcagagtcatcatcaaaccgatggtatgttccgccaccgcttcaggcgaataagctggaacgcggacgacttggatgcctaattcttgagctgcttttaaatcaacattattgaaaccggcacagcgcaaagccacaattttcacaccaagtgcggctaatttttctaatacttttcggctaccattatcattcacgaaaatgcatactacttcgcaatgctctgccaaacgcacagtgctctcgttcagcataaaatcaaaaaattctaaatcgaaattatatttcgcattaatgagctcaatatattttctgtcataacttttagtgctatagattgcaattttcatggtttgctccaattattttaagtttgcaaaagcctgtaataagtccgctttaatatcttctacatcttcaataccgactgaaaaacgcaacaaggtattagtaatcccacgagctacacgctcgggttctggaatatccatatgagtttgagtggcaggataagtaataaaactttctgtgccgcctagactttctgcaaaagtaatcaatttgatggattttaagaatgtattaacccaagcttcatcttgcaaacggaaagacaacatcccacctttatttggataaagcaccgattccacttgtggttgagcttttaaaaattccgcaatggcttgtgcattttcttgatggcgtttcatacgcaaagaaagggtcttcataccacgaatagtcagccaagaatcaaaaggagaaagcaccgcccctgcaccattttgaatataagcaatgcgatcacaaagttcttgccctttcgcaacaattaaaccaacaagtgcatcattatgcccagcaatatatttagttccgctgtgaattaccacatccgcacctaaatctaatggacgagaaagcacaggcgttaaaaacgtattatccacgatcaacattaagttatgttttttcgcaagttttgcaatttcaaccacatcacattcttccattaaaggattcgatggggtttcaataaaaatcgctttcgtatttgggttaatggcagcctcaattgctgaagcagatgctgtattaacataaacaggttttacactattgttatttttataagaaaaatctaataatcgataagtaccaccatacacatcgctagaaacaatccattcatctggggcggtaaaaagcgtcatcaaaacttgaattgcagccataccagaagaaaacgcaaaaccacgatctccattctctaatttagctatcgtttcttctaatactgtgcgagttggatttttggtacgtgtgtaatcaaatcccgtactttcaccgataccacaatgaccataagccgtagaaagaaaaattggtgcagaaaccgcgcccgtacgctcatcactgcgattgccagcttgagctaataaagtatcaatagcatattgttgtgtcataacatcctctaaaaataatgaaaaaattgaccgcactttacgtgttaaaaaacgtttagcattttggcacaaaggaaaaagtgataaaagtagaaattagaaaattacataaaatttcatttttccatcattttctgtgatttatttgaacaaaatgaactttttttaaacggttagacaatttttttaaatctgtaattgacagttatctgaatttccgtaaaatgcgcaccactaacagcgaatgcgggaatagctcagttggtagagcacgaccttgccaaggtcggggtcgcgagttcgagcctcgtttcccgctccaattcgtggcgtgttagcaaagcggttatgcactggattgcaaatccatgtagctcggttcgactccgggacacgcctccataatacgcaaatgttagttgtctatgtgcccgagtggtggaatcggtagacacaagggatttaaaatccctcgcctttcgaggcgtgccagttcaagtctggcttcgggcaccatctaattccaaaccaataatcagtacctagtccaatacttaactttaatttttaattatcgttaggtgaggaattatggacttctcttctgtttctaaaaaaccttatattattactgtcgcttgtactaaaggcggttctgcaaaaagtacaaatgctgccaatattggggcgttctgcgctgaccacggtttaagaactcttcttattgatactgatactcaaccaaccttaagctcttattatgctttaactgaagaagctcccggtggtatttatgagtttttaacccgtcgtgatattgaaccttcccatatcatttcaaaaacatccattcctaatttggatttaattcaatcaaatgacccatcaaacaatgtaagtcaaactctacgtaatgcccctgatggtgcaattcgatttagtcacttaattaaaaacattgataattatgatgttattgtggttgatactcgaggtactagagacattactgtcgatatgtctgtcttagcagctgacatcctattctgccctattcttccacacattctttctgcgaaagaatttatccgtggaactatcggaatgtatcaagatttagaaacctttgaatcatttggcttcaaattaccacctctcaaagctatcgcaaattgcgttgataatactaatgacgtgaaatttgtactcaatcaattgcatgtcctatttgaaaccaattttgatgaaagcaaaaccttccttgatttttcaatccctgcgcatgtggcatatagagaagctgcaacttattcattgccagtttatcgccatagccaagctgaatatcctgttatcaaagaactgtgttgcttgttactccctcaatttaaaacactttttgataaaccaatgaaaaaggaaggctaatatgactgataaacttattgcttctattgaagcggaaagtgcggtcattggtgctctcattattgataatgacaaatttgatgagatcgcaactttactgcgctctgatgatttttatgtctcagctcataaagtattgtttgaaggtgttagccatctattaacacaaggaaaacccgctgatattttaactttggagcagtatttcaaagataaaaaactgattgatcagatagggggattagcatacttagctgacattattcacaataccccttctgcatctaatatcactgcgtatgctgagattatttctcgttatagcaaacaacgtcgttttttgactctgggccagtttattgtaactgaaatgcaatcttcaaaagatgagattgaattaacttcttttgaggaaagtgttgataagcaatataccaatattgtcatcgaacaagagacggatggtgttgctgatcttaatgcaagtttcgagcgaatcctttctcgcatggaaacgtcctctattaatgccgatccagttagtggaacaccaacaggcattattgaattagatagagcaacaacaggcggtcaaccaggagaacttatcattattgcagctcgtccagcaatgggtaaaacaacctttgcacaaacgattgccgcaagtacgttagataaatttcctgacagccctatccaattttacagtcaagaaatgccagctgatcaactattagaacgttttatggcaatgcgctctcgcgtcagcttgcaatctattcgtcaagcgactgagcttgaagaggaagaatggactcgccttgctaatgcaatggggacaattaaaaaagactggaaagatcgtttgttaattgatgatgaagcttctttaacacctcatcgtttacgcgccaaagtacgtaaaaacactcgtctatacggcaaacctaaagcgattttcattgattatatccaactaatgagaactggaaataaaactgaaaatcgcaatttagaacttgccgaaatatccaatgatttaaagaaattagccaaagaaactggatgcccaatttatgcattatctcaactaaaccgaggtttagaaaatcgagctaataagcgtccaatcaatgccgacttacgtgactccggctctcttgaacaagatgctgatgtcatcattcatctttatagagatgaaatctataaccctgacacagaagataaaggcattgcggaaatcatcattggtaaacagcgtaatggcccgttagccacagtaaaaacactgtttcaaggtcaatacagcatttttgagaatttaacgacacaggatagatattatgaataatccatttattgctaaaaataaaaaacaacaaagtcaattagacgcgattgcgaaaggattaaatgttcaacctattaataatcagtctgctgcttatcaaacaacaacagcaacacattatcctgcgcaatctaaatacattaccgttacgttagataaattacgcccttatgaacacaaccctcgtaagacacgtaatcctaactttgaaatgattaaagagtcaattcgtcgtcgtggtcttgatcataaaccaaatatcactcaacgacctggcgaacctttttatatcatcgctgacggtgggaatactcgtattcaagcattaaaagaactgtttacagagactcaagatcaacgtttttggtctattgaatgcttatataaaccctggaaaggtgaaagtgctgatagtgtagaagcggaattagatttgcttattggtcatttaattgaaaatgatacacgtgcagatttaacctttattgagaaagcgttgggaattcagcaagcgaaagaatactacgagaaaaagttaggaaaatccctttctgctcgcgagctttcaagtgagttagaaaaagatgggtatatcattcaattttcaatgattgcgaagatgggacgttgcattgagtatctttatccttatatcccggatgtactttttaacggtttaggtaatgcgccaattgataaattgcttgcgattcgtaataacgccttagccatttggcaaaattatcaatttgaattggaagtgtcctttgatgaaatttggggacacagcctagctcgttgtaatgatgaccaaccgtttcatatcaaagtattccaagaccatctcattgatgaaatgtcatccatgttaggtgatcgtgtaagttatgaagtcctttaccttgaaattgatctcgatgagcaaaaattcaagaaaatggcgcaaaaacaacacgaaatacaacaaagcgtacaagaaagcatccaagatgttcaagcgtttaatacgccacagccacaagaaaccgcattagacacattatctcaacctagcgtagtcaatactccaaaaatgactacccctgaaaaaaaatcaatacctgcgccagtattaaagcaagcaagtgttgaaatttctccttcatttgagaatgaagcagatgataaaacagaggatgaagagtttgatgaaactaatgctagttcagatggcctttcttttgattttgctaaaaatttaactcaacaatttggtattactccaggcatgagcattcaggagcaacgccaacaacgtgcagaagaaaatggattaggctttgcttgcgtaggccgtcaaccagttgatgatatttggaaaatttatcctggtcgtcagcataaagtagaagcttattcactagcactcgacattgcggaaagtgttggattaactgactacattgaacatgtagtaaaagagcctgttgattacacttaccgcgtaaaaccattagataaagatgtgagcggtgtagcacagatgtgttatgacttcttaaatttattacaaacagatgtgcacccacagacatctttcaccttattaccggaatatttactcaatactcaagaaattgatgataccacgctagttaaattattccgtttaattcgcctcgttcgctatattcgttcagaaggagatgcataatgagcatgttcagcaatttaaaccaagtggtattgaatgagattttggttaatttacaagaaggcaatatcaatgtttgccggaactatggtttctcaaaacaagaattgcaagaaattgaaaaactcagcacagaggaagtttatgaactggctaacaccaaagctccctttgccaaagttgaaattaatcacgatgcattttggcgattagtggctcgagtacgcatgtcgtcacaagaacgtcgccttattgatcgcgcattaatgttaggtgcatccatccaaatgctcaattcctacttcggcttaaccacttcaaaagtatctgctcgtcgtagcctacttggaaaacaagaaccaatgggacgtaagccagctgcaaccgaagaggaagaaaaattaatttgggacttatggcaagagcataaaggtgatgttcaaacaattgaatcaacagaaggactagagctgttaattttaattgcggaagaaaccggtattaatttaactgaaatttggaaacttgttagccgctggaatgcagcttaaaaaacataacgcccaacctagtgcgttacgttaagttgggcgttattcatatcgttagtaaggaacttgggaaagttcattggctattgtaaagatgtttaagcacattgcaacaataaaaatgaaatattctcagagagaattaaattatggaaacaaaattacaagagcatgggttgctcttttttggcaaccagcatgaaacagttccaacccgtttgctatttgatccttatttaacatcaagagcaaaattggcatggcaacttataaaatacaaagcaagagaatttcaatcaggcatgttcccatcatacgaagtgcttgcaaaattactttcagataaaccttatgatgaagcagaactctcgcgtaagctagttagccaaacgttgttattacttagattaactcgttggctaacactttgtgaaactgtacgtaatgagcaaggtcaagtattgggtaatttttacatccttcatgatgaacctatgccaatcattgatacgattcaattaaaccatgattacatcgcactccttgaaaaatccattcagcatcgagataactttgtgcgaggtgtagcaaaccatattgtagaaaacctgctctcagataatactcagtggcattatatttctcacattgactggatgcgagctcgccttcaagactatcaaaaacgtccaaaaatggatatttcagagcaagaagaatcaacatttattcaagaaaacttactaagttccaataaggaactcagtgaaaaaacaggggaactcagtaaaaatcaccttagttccaaaatggaactcagtaaaatcaagcagagttccaaaaaggaactcagtacccaaaatgatgataagtcattgatttcaggcttagttccaaaagggaactcaggtttttcacagtacagtacaggtactagtatttatataaatacgtactgtactggtaatgcggatgaaattgactggccgactaatattcagttttcatcattggaaaaaacagcaattatgcaagcaatgcgtggacttgatttaggaatctgtaaagcgattttatttgagctagaacagcgtgtggcaaaaggtgaagtgaaaaaaccacaaggctatgtagtgacattaatccaacgtgcacaccgtggtgaatttaaaccatatttgtatgaacaatttttggctacacaagcgcaatcattatcatcaaaaaatcggttatcacaacatgatgaaactagcttagttaataatgtgaaagccgatagcacaataaaaccaatgcgagtgcaatctgaagaagagcgaaaagcgagagctgatcgcattcgacaatttaaggcttcaatttgcaattgaataagctgtataaaaagtgaatagtgtagaagggttctacaaagtacaaaatttaaccactgtaaagggactttacaaagtacaaattttaaccagtgtgcggggactgcacagtgaacaaaaattaaccactgtgctagggttgcacagtgaacaaaaattaaccactgtgctagggttgcacagtgaacaaaaattaaccactgtgctagggttgcacagtgaacaaaaattaaccactgtccaggggctggacaaagtacaaattttaaccaaatgataaaaggtgacataacatgacaacaacatacaaccaacagcttgggccgttacgcagtgagattacatttacgcttcatactcagtatgcaacacgtctttggaatggtcgtgacttagttaaaaatgaagccggggaagtcgttacatcatcaattctcagtattcctaatgctctatctctattgagtcaaattcagcaagctgccgaacaagatgatccttatgctgatgattatcttcttcgttttgaacaaaaagtattagggtttcgtaaagaaatgcaagatatgacctggagaatggttaatctctacagtgagaaaattcctgaaaactttcaaattgagcgttgtgccaatattgctccgattcaataccctatttttgtgaatactcagctgggttatcaattattgtatcttttggctgactttgattcgttagctcgtacagtgatgaccgcttcacatattgcattacttacaaaagatgatgcgtatgattggttagaatccggagctaaattaattcgtcgtgcatttggtgtgcttgagaattacagaaattccggtattacacgccaagatgcgcttgaaaataacgctcgctatcaagctgctgtaaaacgtatgaaatataccttaacgcctgacgtgctttccggtacaacacgtgcaacatttgctccaacaattaaaaaatcatcacttgctgaatcagatgataatggctctgttgaagtccaaattacagcaaataaaactgaataatggagattgggattatggataacgtgctcattccttctgatatgtataaacaattaggacgcacaaccccacttaatgactcgctgaaacagttattcagtgagttagactcagtgcaacagtatgaattactagctgaatcccttgctacagtccgtgaagctttaatgttgcagcagaatgaaatgttgcagaacgttcgtaaaagtgaacttagtgtattacctattcacatgatccgagataaagcttcatcatccggtgggacgtttttacgctggcgcagttttcaagcctctaagactggtgatgctgtgttaaatccggtatttaataatcctcagttatcttcagacttacgacaaaaacttgtctcagctgagaaagaacgcattttgattaatctgcaggtctccgtactaaattttatgatgagacaggtatcaagtgcggtagataaaattaaagagatagaagatcatttataacattcacatttgtgaacgttggatcttctagtttgtaatcggctaatttatatagtttgtgatcggctcactaaaaggccttttaaaggtaaggggacaagccccttaccttaacgaaaaaaagcctttgcctttcgtggttgtgttaaaaaatctctgtgttttttactgaatttacccttaaggattagatgtaaaaaatgcacaatcttgacagttaattttgtgatttaggagaaatcaatatggctggaattaataaagtaattatcgtgggacatttaggtaatgatcctgaaatgcgaagcatgccgaatggtgaagcagttgcaaatatcagtgtagcaactagcgaagcttggacggataaaaacaccggtgaacgtcgtgaagtgactgaatggcatcgaatcgttttttatcgcaaattagctgaaatttgcggccaatatctcaagaaaggagcgcaagtttatattgaaggacgcttgcgtactcgtaaatggcaagatcaaaacgggcaagatcgttataccacggaaatccaaggtgatgtaatgcaaatgttaggtactcgccctcaaagtgcagatggtgcaaataattctcagccaatgccacaacaagatgcatcggcaaatgcttttgatgattcaataccattctgaactcaatataattaaggttaatcgtgatgaaaaaaataatttttgttttatctgccgtcgctgctttaagtggttgtgctgaattaaactcattgaatgatgcggttggtaatgttgcaggtcaactcagcagtgttcttggcggggggaatagttcctctagttcttccggtgtggcttacactcaaagttctcgttctcatcgctataacgtagaggattcaattacatcatctaaaaatattgactctctttacgtaaaaattaaacgtaatttaaaattcaaaacacgggaggaagcattaagtggattatccgggtatgagcgtcaacgttacgaatcgcttttagatgaagaaggacatgctcatgaagcgactcctggggtctattatcacatggcaaatagctatgttggcggtcgaaaaattgacataacgcttgcaaaagaggatggcaaggttagaatttcctggattgcatcctcaaatgaatctgattttgctcaatttgttaaatcagaagtgataaaagcaattaaataatacgacaacataaacatagtgtaggtaatcaatacctcattctcctttgccccaaccttagtggggctttttttatttcaggtgtttttaaatttcgataccgataataatgattattttgtatgatagataacgaaacaaatttgttttttgagatccatccaaacttttccttttcctcatattgtttaatatctcaaacgtttaccccttggctacaaggggtatttttctcctgtaattgcaaaaaataaattaagtggctcaaaatgaagtgaagataatgggcttgcatactttgacagaattttagctttctctttatggtttctaaccaaaataggaaactcctttacaccatttgcaagcaaccaaagcgttcttgtcataccatcattaagactacagcttatttctccatctttaatatgaacatttacatctgcaagtggaactggagaatccatacttttagcaaatccgttttcagcatgatgaaacttataatcttttctccatgttgactcatcgcccgcacatgtatttttatctacctcatacggtgatcgctgccataaagaaagaaacttttgagcatctacgatgacaatcatgttctcttgattagccatattttcaatatgctgtggataacgcatatacacgactttctgctctctcgttttcattctaaaaataatatatctatctcgacctgaatatctaagcgtatcaaccatcactccaattgatgaaggggtcagttttatcatgatttactcctcagtttaaaaagaattcctaattgtggtttatcttattacatcgaaaatatctctcaaatatcaatgagagaaaacatcatgaaattatttttatgtgaaaaaccatcacaaggcaatgatattgcaaaagtattaggtgcgacaaagcgtggtgagggttgtttatcaacacctgacggtcagcttacagttacctggggaattggtcatctagtagagcaatttaatcctgaagaatatgatcctgcctttaaaaagtgggcatttgagaccttgccaattatcccgggtaaatgggggctttcacctaaaaaagaaacaaaaaaacagttcaatgtcgtcatgaaacttatcaaacaagctaaacttgttgtcattgcaaccgatattgatagagagggcgaaactatagcaagagaattgctggatttggcaggatttcgagggcaaataaaacgcctttggttgtctgcactagatgataccagtattcgcaaagccttgggcgcacttaaaaataatgaggagacactacctctttactatgcgggacttgcacgtagtcgagctgattggcttattggtatgaatttctctcgtctctataccttattagcgcaacaacaagggtatcaagggaaacctttaagtgttggtcgggtacaaactccaacattaagcttggttgttaatcgtgaccgtgagataaaaaacttcattcctaagcaacattttgctttgcaagtaatgctttctgatggaaatcagcattttgctacgcaatatgttattccggagcaatattgtgatcctgatggactttgtttgtctgcccaagttatacaagcagcaaatcagcaaattcgccaatttggccaagcgaaagtggaatcagttgaaactaaacgtgaaagacaaaatgccccactttgctttgcattaagtgacttacaatcagaagctaaccgcctttatggactgggtgcgcaaagagtattggatatagctcaatcactttatgagactcacaaagcgacaacctatcctagaacagattgtggttatttaccggagtctcagtttgcagaagcgcctcaaattatccaatgtttgttgcaatccgataatcgattacacccccttgcaggtatgttaaaccttaatcaaaaatcacgagtttggaatgataaaaaaattactgctcaccatggcattattccgactatgattaaagctgatattagcaaaatgtctgatgaagaattaaagctctatgatctcatacgtcgtcgttatttagctcaattcttacctgtttctgaaacagataagacacaaattattttgaagtgcggtcaacatatattaagtgcacgtgggaatgtgcttattgctccaggttggaaaattctatttggcaaatcacttgatgaagatgatgacgcacctcaagccttgccgacgttaaagcaaggacaaatctgtcagatttctgattcagaaataaaaaccttacaaacatcaccacctaatcacttcacggaaggtacattgctcaccgcaatgaaaaatgcagctcgctttgtaactgatgagcgtttaaaacaacgcttacgagaaactgaagggcttggaacagaagctactcgggcgggaacgattcaaggtttgattgataaaggtttcttgaaaaagaaaggtaaatcactattagcgacagatgaagcaatgacgctaattgataatttacctcagatgttaaaagatccgggtttaaccgcactttgggagcaagcgctcaatcaaattgctgaaagaacgctttcgctagaagtgtttatgcaaaaacaagaagtctttgtgcggcatttgatggctgattgccttaaaaagggaatgagtttggggaatattgaaattcgtaaatgccctaagtgcggtgcaccaatgattaaaagaaatggtaaaaatggggctttttttgggtgttctgcttatccaaattgccaacatattgaaaatattgatagcaagaagaatactaaaagtacaaaaaatttaaagaaaaagtcgagtaaaagtgtgagtgagcaaatttcatctttacgaagcttattgaactaggatttaagcgcctgtgaatggcgagccctcaaaaatagtgctatactaaagccttcgtaagaccgttcgtgaattgtcggttatcaattcacactagccaaaaatgattccagcacgctgaaaggaatttctcacattgattaacgctccttgtgaggtgtgccacctagttaatcagagtaatgatggagtaacgccccaatttactctcgacttttcaaatcgctggccattgcggatttttaaagtgtattgcaaagtgcattttgaaaattcgcaatggcttgctactttttccttaccggagcccaccggtgaaacaatgggtgccctttgtgtcaatttgatgccacagatataaccgattgatggccacaaagtaatcggataaggcgagccgtaaaaatccgtatatggtaacgaacgtatcagtatttttatgaatcaaattagtttggcctacttaatttttatttaatcaatctatagtcaaaactataaggtcattcaggaaactgggtgaccttttcttttgactaaaatatctccaaatagaatttttaattttttatacatttaaggtttgctttagattttaataacaacagtttttaaggtgctgtgaaaacagcctttaagaagttgcacgattcttgagaagcaacgccttgccttagcgcaagtagaatcatagccaaaattttttccagcacactgaaaggagaatctacgaataattcgtaggtgtgccaccttaaactacccttaacctaaaataagattacttattctagtttaatcacaatttaacccttggcgggaaacatttttcccgtgttgggtaaggatgtttctccgcttttttactacttaggagaaacattatgtctactcaaaacgcacaaccaaaatatttcaatcttcatacttctggcattggttatttaagcgatattcgcgaaatcaagccgaaaaaaggagatgcattttgggcttgtcgaattgctgctcttacaggttcttccgattctccggaatatcgtttttttgatatgaacgtatccggtgaagaaactgtaaatttaatcaaacgctgtcaagaagctgttgaagctaagaaaaaagtcttggtttcctttgtaatgagtgatttgtggtatgacacattcacttattcaaaagatagcgaatatcacaaaaaaggtgatactggcgtgtcgattaaaggacgactctatcgtattaactttattaaagttgatggtgagttgaaatatcaagcaaaacgccaagatgagcaagggaatgactaacctataaactgatgaaagccaacaacaaaatttgttggctttttctttaccctgaaggggaaactccccttatgggtggtttctccttttttatttctatttgaggagaaacctatgaatacttacgctaaattttgccctaatgtttttgttgctaaatgtccggatgctcaccaaaaaggtgacgttatcatcttaaccagtaaatacggtaaagagactgaagtggagattcataatctcgtaaaaacctctgaggatgcgtatttttattccttcacccggtgtgatggagtgaatagtcaagttcgtgcagaacaaaaagctgagcgttatcaaaacgcagctaataatgcattaaaacgcagtgaacaatattgtgaagctgctaatgaaggccgtgaatttcttagcttgggagaaccaattaaaattggtcatcatagcgaaaaacgccatagagccttgattgaacgtaatgcaagacgcatggataagtctattgaagaaatgcgtaaagcagaaagttatgacggtaaaatcgcttattgggaacagatggcagggaaaattgatttatccatgccggaaagtcttgagttcttcaagtttgaattggaaaaagccaaagaaaaacaccaagagcttaaagataaacctgaattgcgaacacatgctttttctctcacttatgctaaaaaagcagtcaatgagcttgagaaaaaagtaaaattagccgaattactttgggcgtaaatttaacttttgaaaacataaattggagaaatatatgttttactatgtaaatagtggattagagctaattactttaacaacgcaagagtttataagtgagtttctaggaaaggcaactacccctaaagggattgagccaaatcatttctatgatcctcaaaccaagctagtttatgcatggtactctggcaaatgtgtagcaacttctgagtaccaatatacacctcaagaagcagaagctttacttgttgaattggcattggaaaatgctagtaataatggggatggatcaattatgttccaaccttcgccaacaaaagaagcactaattgctgatatgagtaattatttggaatattgtatagatgatgaatctgagcacgatttagaatttgcagcaaaaattaaacagattatcgacagtttaaaaacttctgattaataacattaactttaatgtgcgataagcattcttttcgcaccttacccataggggatatatcccttatgggcgatattccctattttagaaggaatatcgaatgtttaaattaaacgagcaacaacaagctattttagaacaggcacaggttattttaactaaagtgatggaagaaaagcccttttaccaaggtgcacaggaatttactgagccatcaatagctaaactctattttcaaaccattataggtaatgaggaaagagaaaatttcgtggtacttttcttggatagaatccacagattgattaaatctgaggtgatgtttcaaggatctgtttcagaaacttctgtgtcaattcgggagattattcgacaagcattaaagctaaatgcatcagcaattatcattgggcacaatcatccaactggaaatgttgagcctagtgatgctgataaatatataaccaagagattaaaggaagcttgtgaattaatggatattaaattacttgatcactttatcgtttctggttcagcatctttttgctttactgataatcatcttatttagctaacaacctttcacccattgggggataacaccctcaatggcagtgttatcccctttactttttacattttaaaaatttaggagaaacacttatgtgtaaggaaaatcgtattttagaacttggaaaaatcttcgtctctcgtcgtatcttagcggaattaactaccgaaaagatcaatgaggtcatctcgtggcatcaaaatggctgcattatcatgctggggaataaagattggattgaaaaaccgccacatccgctttcagaaattgttatgaatttctatcaagcagataatggtaaagacaccattcaactctctacttcagtagatgatgacgggaatcgaacaactaagatttctttttctgatgaaagtgaagatgagcaaagaggacactttgattgggatatatatcaatcaaaaagaacaccacttaagttaggggatgtttcgtgtactatctgcgctaaacagttattgggaatgccaaccattcatcgcttaattgaaaaacaattaggttatgattggggtgctacctgcgttgaagattggattgaaaacgatcatgccgtagagaaggataaacgcattgtgagccagcattttattgatggcgaaagtgtttttgtcatcactgaagcagatcgtagttctacaacgattatgctcggatatgaatattaatctatttaccttgaaagcctatctactttatgtagataggcttttcctttttaggatatgataaataaaactctttttaacagtataacgatgccttatttaacttcttcacaaactgaatgcctaaaatggttagctcttatcacgatgattatcgatcacattggtgtggctttttcaaatgcttacccagccctatcctggtgtcgggtgataggtcgattttcctacgtggcgtttggatttatcatcgcgcttaatttatctcgagataaagtaaactttaaaagttatttcacttggatgatagcaaccgcatttttatctgaaatcagttttacgcttttcgagcctaattatgaccgtttaaatgtcctatttcagtttttgtctgtaatcggggtaatatgggtatataaaaaccgtcaagacttaaatagctgggtcatgttttttggattgggcttttttattattctttccgcactctctgattatggtttacctgggcttttatattgcattggttgttacctattcttgcaaacaaaagatactcaatttcgtcttattacgatgctaacctgtgtattgctcgcacttttcgtcaatcacagttttattgataatttcggggaaactattgttgaaacaatcagtgttgttactgttgtggtcggtacaatgatatttattcttcaccctaaaggccttcgtcaatgtaatatctcaatctctcgaatgcctaagcttttcttttatcttttttacccggtgcacttaacaattattattggcattaaatatatttttctcagctaatttttctatctttacttcaagaagaataaattattcaaattcaggtgagagttatccatattaaggcattatttaaataccttaattggagcctcatcatgaaaaaatttctattaaccacttttgcattggttgtgctttcaggttgtgcacataaacaacaaacagccgatgagcaacaagcactagaaaatccaaatattcaacaaggtcagcatcaagttttacaaccggaagatcgaattgttcgtccggatatttacacagactatcagcctgaacgtacagaagtgttacgtgaaggtcgatacactttaattaatttctctccagaagaaggtcaaaaataccttctagaccaaagtgtcactgtcaacatgttaggtaaaaagaaacgagccttaacggcaaccgttgagcagggattacgcacgacgttaaaagatacaggcctttcactttgtcatggttttggtcagaatgaaccaacactttctacgctttattcccgtccattaccaaaagtacattatcaatttggcccgatggctttacgtgatgcccttcaaatgttagcagggccggcttatgaaattactatcaatgacgtttctcgtaccgtttgttttaaattacgcccagctgtaccggaacgtgctacaggggaaaagccgaaagtagaaaccacaacaacgacaacaactacaacagaaatcatcgaggaataagcaatgaatcatgtcaaaaaaatatcctatgtggcgatgatattagggatgttttctactgctgtatttgctgaagtcactgcggctaatacacttgctactcaatccctcaatcaacaaaacttggtgacaaataaattaaatcaacaagagttattagctaagtctcaagagtggggtttaactgagcaagaatggcaacgctaccaagagcttaatcaaggtgctcgtggtatatggtcgccaggtcttgaccctttaacctcgcttggtgtggagtctcgaaatgagcaggaaagagagcgttatgctcgactactggcaaaaaaaatgcacgaccgcatggagagagagctgcagttccaacgcacttatgatcgcgtatttgctgaaatgtatccaaatgagcaaccatttaaggttgaacctcatatttcagagcggtttggacgggtgatttattttactcgcctagaaaattgtgacaaatgtgaagcgaatgctgatcgtgtactgcaatatgtgaatgataaaacgcctatagatatttattttgttggcgtgaataataatgagcaaatctataattgggcgaaaaaacataacatcgacccaaataaagtgaatagaaaattaattacccttaatcatgataatggagcctggttacagtatgcagatggcaaaatgcctgctgcattccaaattcaacaggatgggcaatggcaacaaatcgtctattaaaaatcgtatttagcttaatcggtcttggcgttgcgactcactccgttgcatttaatggctttggaactgatattgatggctatattaaagatgcatctaatcgctaccaggtcgatgaagcgatgctacgtgggttagtaaaaattgaagatgggtggtatggaaatgtttccccaaccggggcaaccggtgtggggcaatttacccggggcacctggaattggcttgcaacaactgatgaggggcgagccttaggtatgactcaaatcactcgttacaatcgtgatacacctttcgaccctagaaaaaacaatcaacttaacactctagcaaccgcacttttagctagatggcatattaatcagttttttgagcgaggcataaaaccatcccatgaaaatttatatcttgctcataatatcggtatagatggtttacatcgagcgctacaaggtagagcaacacgtgaagatattctaaatatgaagcgtaacgggatgaaaaaaggaatgtcggtacaaggctttcttgtttatcaaagtgagcgttttaatgtcagtaaacaaatagctaacttccagcgcccttcagtatcaccacgttatcaaattgagaataaaccattaccagccaatttacattgggtttctccaacagaaaccgctatgcgttgggttgagccagcgtcaaatcaaacaaatcaacaagctattcgttggcaaaatccaaccaattaatacgagaacagaattatgcagtataaatcctttttcctctctttggtctgcttaggagcagtagttcaggcgcaagctgaattaaaagttattggtgattttggcggagaaagtgcagtccgtttttatgaagcattacaaccggatgaatcaatggttcaagcctaccctaatagcgttccttcaacattgaccgaagcggatattttacctgttatctcacatagaatgacaccgggccaaatacaaccagtcagaatgaatcttcctggaatgttgcctatttttcttattggaacagataacttatctaaaaattggctacacgctaattataattaccttaaaaaaattggtgcaatgggacttgtagtaagcgttaaaacaacaaacgaattaagcgagttacgccaattagcaccggatttaaccttaatgccaacgccaggggatgacttagcttcaagattaaatcttgctcactaccctgctttattgacttcagaaggattgtcgcaatgagtcaaaaacatgtattagaaggtttacttagaccgcctgttgaattttttccagctgccgtccatggtacttgtgctttggtttgttgcggtgcgccttggtcgctcgcattaaatcctcttattggatatggattaggggccgctttcgcaggtatgggggttatgcgttttcgtcaaggcatggaaattgtacgctatcaccgaaatttacgcagactccctcactatgctttgaccagtcgtcaaattccagtaagtaaaaaagccttgttcttaggacgaggctttgaatgggaaccaaagcatacgcaacgtctttatgactgtttctctgcaaatgggcaaatttattggaaaaatgggaagtggtttaaagccgctcgtgattatgaaaaagtgcatgataattggttatctagactcacttcaatggactctccattaaatccagtcagaccgctaccgccagttggcggcattccagtgatgcatggtgtggagccgaatgaacgcgatattatgcttccgttaggcgaccgtggcggtcataccttagtatttggtacaactggcgtagggaaaacgcgttttgctgaagtgcttgttacacaagatatacatcgaggtaaaacacctgaagagcgtgaagtggttgtcttttttgatccgaaaggcgacccggatatgttaaaacgaatgtatgcagaagcaaaacgtgcggggcgtgaaaatgaattttatgtattccatttagggcatccggaaatttctgctcgatataacccagttggtcgcttcggtcgaatttctgaagtggcaggacgtatttctgggcaattaagtggtgcgggaaatagtgcagcatttaaagagtttgcgtggcgttttgtgaatattgtctcccgtgcattggttgaaatgggaaaacgcccggactatgtgcaaatctcgcgttttgtgcaaaatattgatgcacttttcttagattacgccaaacttcattttgatgccgtagataagaaaatatggccaacgttggcttcggttgcggctaacttagatgtaaaaaatttaccgttctcgatgaaagatagaccgctgattgctgttattaaccaatatattttagagaataagatttttgacccggtacttgaagggttatcaagtgcggtacgttacgataaaacctattttgataaaattgtggcatcgcttttaccgttacttgaaaaactcactacaggtaaaactgcagagcttctctcgcctgattacactgatattcatgatgagcgccctatctttgattgggaatctattattcgtaaaagagggattgtttacgttggattagatgcattatccgatgcgaccgtagctgcagctgtgggtaatagtatgtttgctgatttggtatcaatggctggtcatatttataaatttggcgtagatgaggggttgccagatgcatttaaaactaaaagcaaaccgcctaaaatcaaccttcattgcgatgagttcaatgaattgatgggggatgaatttatcccgctgatcaataaaggtcgtggtgcgggaatgcaggtaacagcctatactcaaacactttcagatattgaagctcgtattggaagtaaggcaaaaacgggacaaacaacaggtaacttcaatacacttttaatgttccgggtaaaagagccggccactgcagagtttttaacgcgtcagctcaacgatgtcacaatttatcaaagcatggtgacatcaagtacgacagataacagcaatccggatgatggcaaggcgtttacttctaatactggtgaacgtatttctgaaaaaatggtgccaatgctatcgccagcacatattacaaatttaccaaaaggacaggcatttgctcttcttgaagggagtacgctttataaattaagaatgcctttacctgcggttgataaagatgatgtgatgccggaatcacttcaagaattgacggcttatatgcgcaaaaactaccatatttctccaaattggtggcaatctgcattttctgattatgcgccaagtcaagatatagcaaccgcttttcagtcaatgtcattaaatcgagcgccttcacacgcaggagaagaaatgcttttcggggatgttgaagctccagttgctgaagatatggaagatgaagatattgatcagaatgatgatacagatgaggatgattttgatgacacagataattaatcagccggatatgaacttgcttgatattccggatatgagcgtagatttcaattcagtcactagctgttcttgtgggctggaaaacgctgatgaattacttaattactttttaccttatttggaagattggaataatcagcgttataccacacatgaatttgcgaaaaagtatgcaaataaaggcatctcactttggacggctaatgatgtaaaaaaatctgaaaatggcatccaggcaattcaaatttttttagacggtgaagtaaaaggttatcttttctttcactgtaaattatctccagcgggaacattacagtaatggcagaacaacaagtcaaaaaaaagaaaaagggtcttttttactacattaatgcggtattagccgccttattgggttccctgattttgagcattattcttgaatggttaggtattgcatttttatggcctgaagaaggtcatttacacagtcaaaaaatgatgctaactgagcttggatggctttctgatagtctaacgagaggtcttttctatcattctccaaaagagctggctgaaggtcttattttgtcattacatgaatggctttttgtgaaaacaggtgtaaaagattggttagccaaccctcgtgagcatagtggcgtaggtttgtgggtgtatcattatgggcgagcgtatattgagtcagtgatttatgtttttatcacctttgttattcgacttgtagtgattgtttttacttccccactctttttgttagccgcatttgcgggctttactgaagggttaatgatgcgtgaccgtcgtaaatttggtgcgggcagagagtctagttttctttatcatcatgcacgtcgattaattggcccgattatgttgtcggcatgggtattgtatctttctatcccaatttctatttacccgaatataattttggtgccagctgcatttctatttggactatccatctgtgtaacggcagcgagctttaaaaaatacctttaatattcctctatgttgtcattatgggtgcttatttttccaagaataagcgcccttttttatcactaaaaactgttttgaatttaaaaagagtttctcattaaatttccctctcttctttggcactctttgcttggaatctgtttcaagtaaggagttctccgtgactaaaaatattttcagtttatctctagcaatagggttattgtttggcgctataagtgctcaagcaacagagcaagagcatttagcgcaagcaattaaacagttggatgcagcaaaactctcattacagcgagcagctgcaagtgcaaaggtttctgcgaaaagtcgtgaatattttgattacgcttcagcacatcaagatattgctacggtacaggcagggattaagcaatatattaacccttcccgggcaatccctagaaatcctaaagctattcgtaacttaaaagaagattatctcaatcttcggagtcaatagcagatgagtaacgctaatttcccttctgtttcaccattagacagtttttatactgtaagtggtttagacccgctaaaactgaaaatcatgctggccattattttggttgtcgtattactgcttgcgtatatgtgggcaactaatcatggctacaaaggcatggtgaacgacggtgatatttggtcattctttaaactgattctatggggcgcagcattaattatatgtgttgtcagcttttttatttaacaaaccataaggacatctcatgaagttgattaaatccttctttcagaatgtttcaagtcgttttcttgcggtagtaactttactttggttatccgttgaaaatgcgtttgctacaggcggtggtaatggtatcaatgcctctaaaatccctgattttaaaatcccaggcgtagatagcaataccaaagacccgatggaaatcatctatcttgttgctaaatcattggcaaccttgtgtgcaattttatttgcagcatggtcaatcatgacagtggttaaggcattaattaaaacctataacgcagcgactgacgaaaatgacaaaaaaggatggggcccatttattatcgctcttattcttggtttcattttaattttcttcagcctctggttggtgaaattggctatcggtctgttttaattatctctgtgaggtcaagatgtcaagcgataaagaacaaacaatcccctttcttcctactcgattaaatcgtgaatcgagtgtgtatggcgggttatctgtaagtgaatttatgttggctgcagcaatgggatttatcttgggtgcagtgcttggcctcctttgttgttttgccttaggctttgatttttggttgttaattccgtctctcgccatgttgttttgcattctttctgtggtgattggcaaagtgattattgcgcgccttaaacgaggtaagccggaagcctacttgaatcgaatgattgaggttaaattagatggaatattaggggggaatcgctttatctcccgtcaaggcacttggtctattcgccgagttaaaaaataagagagtttattatgagtaacttaaaagggattgttcatcaaaaaaatcgcgaaatcatgaccgggcgaattgctatcggtgcattgcttgtgatttgtttggtgctatgtgccattatttttaccgcaccaagtcgattaatgatttataacccaccggatttacgtgcgggaagtcaacgcccttggtgggaagtgccaaaatcaaccgtttatgcctttgcttatcaaaccttccagcagttaaaccgctggatggagaatggcgaggaagaatacaaattaaatattgaaagaaataaagcctttattacgccaagttgccaagaatttttgaagaaagactactatgaccgtttatctaacggtgaattacgtgaacgtgcacgtggtgtttatgaaattgtgggacgtggatttaaagacagtagcgttattgtgcatagtccagatagctggacggttaatcttgatttaagtgtagatgagtatttcaaagatgaaccagtaaaacgtgttttaacccgcttcccggtcaatatcgtgcgcatggaaacagatttacagaacaatccttggggattgggatttaactgctacagctcaattccattacgtttagaagcaaaagaatttagagaaggggataaccaataatgaaaaaactcactttgttactaagcgcggcttttatcttttcaccaatgacggcatctgccgatgtgttaatgaaatgggcgcgcaaaccgttacctattgacttacaaatcgaaaaagaacgtattctattcgtagataaaaatgtaaaagtaggttatccacctgaattagatagcaagcttcgcattcaatcaactggcggtgcggtttatttaaaagcaactgcagatttcccaaaaacacgcttgcagcttatggatgttgcaactggagaaataatcttacttgatgtgcaagcgaagcattctgttgccaatgcaagtgagccaattcgctttgtttatgaaaataaagttgaaaaacaaacaactgcttatggccaagatgcaaatgcatataacgaaccaatgccaaatgcgcgtccggcactccccgctccagctgcattaacacgttatgccgcacaaatgttttatgcgcctttacgttcagttgagcctttggaaggtgtgcgccaagtttcacatcgccttcctacaccgcttaaaacgctcttacctgcattgcctgtgcgagctactccattactcagctggcaacttgatgagtatgttgtcactgcggttcgcttgcaaaaccaggggcaatctcgcattgatttagatcctcgagagcttcaaggtcgattctatgcagcaacatttcagcataattggcttggggggcatgatacacctgaagataccacaacgttatatcttgtgacagaaggttcacctaatcattctgttatccctcagtcaaattcatataaaccgaaaaaattgaaaaaagtcaccacaacagtgacaactcaaacaaaataaggagcgaacaatgcaaatgaaagcaaataaagcgttctatgttattggtgggattaccgctcttgtcgtgacgctgatggctggatttcttttctccggtagtagttcaacaaatacagcagaaaccaagaaagaagatactttagatatctcttttaaagatttatcaccggaagaattacgagcaatggggattgagggtgacacatctaaagatacggtaagaacacttataggtaaagtgaaagagcataataagcgatttgatgaagtgattttacaaaatgaacgcttggtaaaagagaatgagcagttaaaaaatcaagcaaacaatacggattatcaaattcaacaggcggtacaagcagaaacaggggcgttaattaatgagattaatgcgttaaaagatcaggttgtacaagctggtaatcaagttgtagggaatggaaatgcccaggcaaatcccaatgctcctctaccaataaacggagcaacaactggccctcaggttgaaactcgagggggaattaattgggtgaaccctagtgatatgccaactacagacagacaagggaatgctctacaaggtattggtgtaaatggtgcaggaatcggttttcccaaaaccttcgataacaatgtgaatgacatccgaaaatctaatgatgggttgcaatctagtacaggtaataatgcaatatttaataccgctacaccatttttcacaattgcagctaactctactttaactaattctgttgctatgactgcgcttgttgggcgtgtgccgattgacaataaggtaaccgagccttatccgtttaaattgcttattggtcgagataacttaattgcaaatggcattgaactgccggatattgaaggcgcaattgtctctggaacagcaagcggtgactggacgctatcttgtgttcgtggtgatgtgaaaagcttaacttttgtgtttagcgatggccgcattgtttcaacagacaattctgacgataaaattggctggttatctgatccacatggtgtgccttgcattcctggagaacgcagaacaaatgctccggaatatctaacgaccaacttcttcttaacgggggcttcagcagctgcacaaggcttatcatcttctcaatcaacaacagtggttgatggcggtgcagtaattggtgcggtaacgggtaataacggtaagtatattcttggtcaagcgttaggtggcggtttgagagaaacagcagactggttccgtcagcgttatggccaaatgtttgatgcggtatatgttccaccgggtaaagaagtggctgtacacatcgaaaaacaaattgatattgattatgaccgcatgtctcgaaaagtgaaatacggacaagcctcaagacaatctaacttggattaaggagcaataatgaaagttttaatgatgatgggcgtgattttagccgcaagcagtgttttgactggctgctcaacttctcaaggtgatttattgccaacaggcgatgcaacaatgaaagatatttggaatcgaggcggtaatgatagcaatattacatcttatcggacaccgaatggccgtcttattgatgcaccaaattacgtttcatctcgtgaacaacaaacttatacccgtacagcagaaaacgaggtgaaaaatcttttccctcgtttaccaaaccctgatttagtgatgtatgtttatccgcacttaactgattcctcagagcaaatgcctgtaccaggttattcttcagtaattccattttatggacgtgtgcaatatgcccaaccgggtgagcgtacaagaatgtactagatgaggtaagaaacgatggcattattccaagacgtgttagaggctttcttccctgctaaaaaaggtgataagcctcaacctaaaaaggaacctatcctaacatccattgcaccggaagaagcacagcaggatgataccaataacgtagaagagacgattgaaatcactcctgttatgcgtaatagaaaaatgaccagagagcaacatgttaaaatgctttatgggcgcgatccctcttttatctccaatcttccttatgcggaatatttggaagaagaaggcgtaatgctttttgatgatgctaaaagtgcaggtgcggtatttgatattaagcctataggaactgagggaagaagcagcgactatcttaatcgcgttcgcacattggttaaagatgccttacaggatagtttcgatgaacttgataccaacccttacgttgtacaattctattgccaggatgacaaggatttaagcggttatgttgagaatctgagacagtacattaaaaccacttcacctgaagcgagcggtagtgagtttacagaacagtggcttggtgaaatggagcgtcacttaaaagcagtaggtaaaccaggtgggctttttgttgatgaccgggtaacaaatacggcatgggctggaaaagtgcgtaaaacacgcatggttatttatcgttatgctggaaataatgagacagatacaatcgagaaattaaatacagcttgtgatcgtgttcaaagtgcttttatcacagctggattaaccatggaacgccaaaatgaaacacaaattcatcgttggttattagaatggtttaatccaaatccatcacgctattttaacggactcgatgataaagcttgctatgatcttttatcactctctaaggatgaatctgctctaccattacaagaccaagattttagtgaaaatctcttttttacgccaccggaaagtaaaaatggctattggtattttaatgagcaacctcacgaagtcattgtagttgataatattcgtaagcagccggatgttggccacatgacaggcgaagtcactcgaggtcgtaatattaatgcactatttgatttattgccggaatcaaccattatggctatcactgtagtcattcatcctcaagataaattacaggcgcatttagacaaattaagtagtcgagctgtcggtaataactatgagtctatctatttaaaacaagatgccctcacagtaacggaatatttaaaagacggacacaagctttatcaagctggcatggttttctatgtaagagggaaagacgatcaagagctacgcattcgctcaagagaattaagaacggttttactcagtaataatttagtgccggtaaaagaaggcaacgaagttgcgcctcttaatagctatttacgctggctaccgatgaattttaatcctcaattagatgcaaaatctcgtttttataccaaatattattgggtgcaacacattgcgaatatgttacctgtatttggccgtgagaccggaacgggacacccaggaatcacctattttaaccgcggtggaagcccattagattttgacccactaaaccctaaagaccggactaaaaatgcgcataagctcattttaggccctacaggttcaggtaaatcggcaacattaaccgcacaaatggcacaactgatggcggtgcaccgtcctcgcttgtttattgtagaagcaggtaactcttttggattgttttcagattatgcggagcgttacggtttaacggttaaccgggtatctcttgagccaagtagtaacatcgctttaccgctcttctctgaagcgcatcgtttattggaaatggatatcgatcttgaagttcaagatgatgacgataatgaagatgaaggcgaggaacaacgagacttacttgcggaaatggaattaaccgctcgcttaatgatcaccgggggagaagcgaaggaagatgagaaaatgagccgtgctgaccgctcggctattcgccaggctattttattagctgcagagaaaacttcacaagagaccccacctcgtcaagttttaaccggggatgtaaaagccgcacttgaggagttaagtcgtcgccaagatattcgcccggaacgtgcatctcgtcttgcagatatggccgaagcaatggatattttctgcactggggtaaatggtcgattctttaaccgtgaaggggaaatttggcctgaagctgatattacacttgtcgatttggcgatgtttgcacgtgatggctatgaagctgaattagcgatttcgtatatttccctaattaaccatatcaactcattaggtgaaaaatatcaacacagtttccgccctatcgtgaacattacggatgagtcgcatatcattaccgtaaatccacttctagctaagttcctggttaaaggttctaaaatgtggcgtaaattgggtatttggttatggttagctacacagaatatggctgacttccctgatgaatctgataaattactcagcatggttgaatggtgggaattacttaacctttctaatgatgaagtcgaacaggtaaaccgtttccgtcgtttatccgaagctcagaaaatgatgttgttatctgcgaaaaaagcagataagaaatatactgaaggtgtggtgctcgcaaccaatatggaagccttattccgtgttgttccacctagtctttacttagcactagggatgactgaaaaacacgagaaagcacaacgtaaacaattaatgatggaacataactgtactgagttagatgcggcattgatggttgctaaagacttagacaaaaaacgggggattgcagtcaatgacgaacttaactcaatcgcagcctaatcctaatatgacttttcatcgtatttttgacattgggcctcgcatccaatcacttgcttttacctctgatgaggtgaaagcctacgtgctgcatttcattgcaaaaattaagacaaaaattggttcaaactgccaattaagcgcatttcctcagcgtgtatttactcaatcaagttggaaagtacacgctaaaggagataaaggtgaagtgcatttattatttaatatctccgggcgtttccaattacctgtgtttcttccgaaaactggccagctagacttaatgtggaattaaccgatcacgttgatgcatattggttaattcaatatttgctttggaaattagctgcaatttgggaatcccctgctgacttatccccagtttttggggataagactgtgggtaatgaataaggagtcctgatgtctcaaggtaaaaagccacaatcaagaggatggcttaaaaatgtactccgttttattgctatccttttatttttatttttagcccttactgcaattggcatctttgcaactcaatatcttcagaatgttgatattcgtgcttggtttattaaaacgcagtggatatggtttgcagtacgattattactatatggtgcgattatgttgatggtctattccatttctcgtcgccaaccatcttctatgccggcaaaagcaaaatggttaattgcgatgattttaatttttgctgaagcgattacacagattactttagcttagggggaaatatgacattctcagttgacagttatcttgaatatttcctgactctacttggttggttgcttaataacggagtttttgcgttatttgttggaacagggttatggcttcttccgcttatcggaatgatctttaaaatttggcgtgacgtagctaaacaaggggatgatgaaggtgagaaaggggatttattaatccgctggctcacaatcgaactccttccagcaatgcttatcgttgttttgacattagcccctcttatcccggtatcattgaataaccttgaatacaatgaacgttcatctattcaatgtggctataaagttcctgcttccccggataaatcaggctatgcgccatttacgacaacatttggagacagacaagcccgaattcctatttggtggatgttgatgcacaaagtggataaaggtctaacttatggtatgactgcagtattgccttgccagcgtgatttacgtcaggttagatttgaagtgcaacatcaaaaaatcactaacccagcattattaactgaagtgcagcaatttgtgcaacaatgctatatcccggctcgtcaaaaattacaaacaagccaacttgccttgagtccggcacaaatccgcgaaacatcctggttaggtggtaaattgcttattaataacagcgagctctaccctcgttttagggctcagcaacctattagcacgttcccttatgatgcaaatcgagatgcggcattacctaattcgggaaaaggtggtttcccaagttgtgatcaatggtgggatgaaagtggagctggattaaaatctcgcttacttacagatatgcgtcaaaacttatctgcccaggtgagtgatttctttaactctatcgacaaccaagatgaagctttattgagaacacttttacgctctgaaaacatagatgtttcaaaagggaaaatgtatcaaggttacggtggtagcgtggatgctggattttggaatgcggttactcgactcacctcaactgtaggaacggctgttggaagtttggctatattcccaggcctagatgcaatgcgacaagccctaccaatggttcaagcctttatgattatggctgtaattattttaattccaattattacgattttaagtggctttgctattaaaactgtaatgacattaagcttcgtatattttgcactcattacaaccacattttggtgggagttagcaagatggcttgattcatacctaatagaaattatgtatagttctccatctcataatatgctaaacatccactttttagaaaatgcagaagatgacattatttctaactttgtgatggggagtttatttataattttacctggtttatggtttggagcaatgacctgggctggaattcgagtgggtggcgagcttagcgctgccattgcgaaaggaactgaatcatcccaaaaatcaggggggcaatttggagataaaattagtaaaaaaatataacgtataaaaaaagtccatctgttagacagatggacttttttatttacgaaaataattaatcgtcatcatctccgtaaacttttactccgttaatataatagccaaacccctgaaaaccataatcccactttccttcttctgatgaatcatcatttgcaagtaattctgacaacaaagatgtatcacttactggctcttcatctaaatattcaatgtttttagaaggcttggttttggaaattataactccggccaaaattggactcgcagcaagagcagcagctgtcacaacagctttacgaggctttcctgggagaaatgacaaagtgcggtcaattttcttaaaaaattgtccgacagtatggccaaacttttgagcgtccatattctctctcctattaaaatactctgacttactctcattgtactcttattattcttttattaaaacctcgttttaagcaggaaaaatgtgatttttgcgatccacgtcgcaaattttactaattnnnnnnnnnnnnnnnnnnnnnnnnnnnnnnnnnnnnnncaacgttttctgcctctgacgcctgatttaatggtctcagatgtcctttggtcttttctcctgccagcataaaggaataatggccgagcatattgatatgtccgtggcaaagcgggagaggctcg

SEQ ID NO: 686 - DNA, 1974 bp, H. influenzae
atgattaatagacgtcattttattcaaattggagcaactagcatcctagcgttaagtgcaaaccgttttgcgatggcaaaaggaaagagcgatgttgatttacgcattgtggcaacaacagatgttcatagcttcttgaccgattttgactattataaagatgcaccaaccgataaattcggttttactcgtgcagcaagccttattcgtcaagcacgtgctgaagtgaaaaatagtgtattagtagataacggtgacctaattcaaggtaatccaattgcagactatcaagctgcacaaggctataaagagggtaaatctaaccctgcggtcgattgtttaaatgcgatgaattatgaagtgggtacattaggtaaccacgaatttaactatggtctcaattatcttgcagatgccatcaaacaagctaaattccaaattgtgaatgcgaacgtagtaaaagcggggacagaagaaccttatttcacaccttatgtcattcaagaaaaatctgtggtggataataatggcaaaacacataaattaaaaattggttacatcggctttgtgccaccgcaaattatggtttgggataaagcgaaccttcaaggtaaagtggaaacccatgatattgtaaaaacagcgcaaaaatatgtccctgaaatgaagaaaaaaggggctgatattatcgttgcattagctcacacaggcccatctgatgaaccttatcaagaaggtgctgaaaactcagcattctatctagctgatgtaccacatattgacgccgttatttttggtcactcacaccgtttattcccaaataaagaatttgcgaaatcaccaaatgcagacatcgtaaatggtaccgtaaaaggcgtaccagaaagtatggctggttactgggcaaataatatcagcgtggtggatttaggcttaacagaacacaaaggcaaatggattgttacctctggaaaagcagtacttcgtccaatctatgatgctaaaaataaaaaagtgcttgcagaaaatgacccagaaattaccgcacttttaaaaccagttcacgaagctacacgtaagtttgtttctcaacctattggtaaagccacagacaatatgtacagctatcttgcattagtgcaagatgatccaaccatccaaatagtgaaccaagcacaaaaagcgtatgtagaaaaagttgcaccaaatgttgcagcaatggctggcttacctattttaagtgcaggagcgccatttaaagctggtggtcgtaaaaatgaccctacaggttataccgaagtaaataaaggtgaattaactttccgtaatgcggcagacttatatctctatccaaatacattagtcgttgttaaagcaacaggcgaacaattaaaagaatggttagaatgtagtgctggtatgtttaaacaaattgaccctacaagtgataaaccacaatcattaatcgactgggaaggtttccgcacttataactttgatgtgattgatggtgtcaattatgaatatgatctaactaaacctgcacgttatgatggtgaatgtaaattgattaacccagaatcgcatcgtgtagtgaatctcacttatcaaggcaaaccggttgatccaaaagcagaattcttgattgcaacgaataactatcgtgcttacggtaataaattcccaggcactggcgatcaacatattgtttacgcatcaccagatgaaaaccgtcaaattttagctgattacattaaagtaaccagtgaaaaagaaggttctgtaaaccctagcgcggataaaaactggcgttttgtgcctatctcaggtaacgataaattagatgtccgttttgaaacctcaccaagcgaacaagcagctcaattcatcaaagaaaaagcacagtatccaatgaaacaagtgggtacagatgaagttggatttgctgtataccaaattgatttatctaagtaa

SEQ ID NO: 687 - protein, 657 aa, H. influenzae
MINRRHFIQIGATSILALSANRFAMAKGKSDVDLRIVATTDVHSFLTDFDYYKDAPTDKFGFTRAASLIRQARAEVKNSVLVDNGDLIQGNPIADYQAAQGYKEGKSNPAVDCLNAMNYEVGTLGNHEFNYGLNYLADAIKQAKFQIVNANVVKAGTEEPYFTPYVIQEKSVVDNNGKTHKLKIGYIGFVPPQIMVWDKANLQGKVETHDIVKTAQKYVPEMKKKGADIIVALAHTGPSDEPYQEGAENSAFYLADVPHIDAVIFGHSHRLFPNKEFAKSPNADIVNGTVKGVPESMAGYWANNISVVDLGLTEHKGKWIVTSGKAVLRPIYDAKNKKVLAENDPEITALLKPVHEATRKFVSQPIGKATDNMYSYLALVQDDPTIQIVNQAQKAYVEKVAPNVAAMAGLPILSAGAPFKAGGRKNDPTGYTEVNKGELTFRNAADLYLYPNTLVVVKATGEQLKEWLECSAGMFKQIDPTSDKPQSLIDWEGFRTYNFDVIDGVNYEYDLTKPARYDGECKLINPESHRVVNLTYQGKPVDPKAEFLIATNNYRAYGNKFPGTGDQHIVYASPDENRQILADYIKVTSEKEGSVNPSADKNWRFVPISGNDKLDVRFETSPSEQAAQFIKEKAQYPMKQVGTDEVGFAVYQIDLSK

SEQ ID NO: 688 - DNA, 1494 bp, H. influenzae
atgacattctcagttgacagttatcttgaatatttcctgactctacttggttggttgcttaataacggagtttttgcgttatttgttggaacagggttatggcttcttccgcttatcggaatgatctttaaaatttggcgtgacgtagctaaacaaggggatgatgaaggtgagaaaggggatttattaatccgctggctcacaatcgaactccttccagcaatgcttatcgttgttttgacattagcccctcttatcccggtatcattgaataaccttgaatacaatgaacgttcatctattcaatgtggctataaagttcctgcttccccggataaatcaggctatgcgccatttacgacaacatttggagacagacaagcccgaattcctatttggtggatgttgatgcacaaagtggataaaggtctaacttatggtatgactgcagtattgccttgccagcgtgatttacgtcaggttagatttgaagtgcaacatcaaaaaatcactaacccagcattattaactgaagtgcagcaatttgtgcaacaatgctatatcccggctcgtcaaaaattacaaacaagccaacttgccttgagtccggcacaaatccgcgaaacatcctggttaggtggtaaattgcttattaataacagcgagctctaccctcgttttagggctcagcaacctattagcacgttcccttatgatgcaaatcgagatgcggcattacctaattcgggaaaaggtggtttcccaagttgtgatcaatggtgggatgaaagtggagctggattaaaatctcgcttacttacagatatgcgtcaaaacttatctgcccaggtgagtgatttctttaactctatcgacaaccaagatgaagctttattgagaacacttttacgctctgaaaacatagatgtttcaaaagggaaaatgtatcaaggttacggtggtagcgtggatgctggattttggaatgcggttactcgactcacctcaactgtaggaacggctgttggaagtttggctatattcccaggcctagatgcaatgcgacaagccctaccaatggttcaagcctttatgattatggctgtaattattttaattccaattattacgattttaagtggctttgctattaaaactgtaatgacattaagcttcgtatattttgcactcattacaaccacattttggtgggagttagcaagatggcttgattcatacctaatagaaattatgtatagttctccatctcataatatgctaaacatccactttttagaaaatgcagaagatgacattatttctaactttgtgatggggagtttatttataattttacctggtttatggtttggagcaatgacctgggctggaattcgagtgggtggcgagcttagcgctgccattgcgaaaggaactgaatcatcccaaaaatcaggggggcaatttggagataaaattagtaaaaaaatataa

SEQ ID NO: 689 - protein, 497 aa, H. influenzae
MTFSVDSYLEYFLTLLGWLLNNGVFALFVGTGLWLLPLIGMIFKIWRDVAKQGDDEGEKGDLLIRWLTIELLPAMLIVVLTLAPLIPVSLNNLEYNERSSIQCGYKVPASPDKSGYAPFTTTFGDRQARIPIWWMLMHKVDKGLTYGMTAVLPCQRDLRQVRFEVQHQKITNPALLTEVQQFVQQCYIPARQKLQTSQLALSPAQIRETSWLGGKLLINNSELYPRFRAQQPISTFPYDANRDAALPNSGKGGFPSCDQWWDESGAGLKSRLLTDMRQNLSAQVSDFFNSIDNQDEALLRTLLRSENIDVSKGKMYQGYGGSVDAGFWNAVTRLTSTVGTAVGSLAIFPGLDAMRQALPMVQAFMIMAVIILIPIITILSGFAIKTVMTLSFVYFALITTTFWWELARWLDSYLIEIMYSSPSHNMLNIHFLENAEDDIISNFVMGSLFIILPGLWFGAMTWAGIRVGGELSAAIAKGTESSQKSGGQFGDKISKKI

SEQ ID NO: 690 - DNA, 1563 bp, H. influenzae
atggtggattctgttctattagttgttgatgcgtttgatggcccaatgccacaaacgcgtttcgtgacacaaaaagcattcgctcatggtttaaaacctattgtcgtaattaataaagttgatcgccctggtgcgcgtccagactgggttgtggatcaagtatttgacttatttgtcaatcttggtgcaagcgatgaacaattagacttcccaattatctatgcttcagcgctaaatggtgttgcaggtcttgaacacgaagatttagcggaagatatgacgccattatttgaagccattgtgaaatatgtagaatcgcccaaagtagaacttgatgcgccattccaaatgcaaatttcacaattagactacaacaactatgtaggcgttattggtattggtcgtattaagcgcggttcgattaaaccaaaccaacctgttactatcatcaatagtgaaggaaaaactcgtcaaggtcgtatcggtcaagtacttggacatcttggtttacaacgttatgaagaagacgttgcttatgctggcgatattgttgctatcactggtttaggagaattaaatatttctgatacgatttgtgatatcaacgcagttgaagcactgccatcattaacggttgatgaaccaacagtaaccatgttcttctgtgtaaatacctctccatttgcgggacaagaaggaaaatatgtcacatcacgtcaaattcttgaacgtttaaataaagaattggttcacaacgtggcattacgcgtagaagaaaccccaaacccagatgaattccgtgtatctggtcgtggcgaattacatctttccgtgttaatcgaaaatatgcgtcgtgaaggttatgagcttgccgtttctcgccctaaagtaatctatcgtgatattgatggtaaaaaacaagagccatacgaacaagtaactattgatgtggaagaacaacaccaaggttctgtgatggaagcattgggtatccgtaaaggtgaagttcgtgatatgttgcctgacggtaaaggtcgtgtgcgtttggaatacattatccctagtcgtggattgattggcttccgtggagactttatgacaatgacttctggtacaggcttactttactcaagctttagccactacgatgagatcaaaggtggggatatcggccaacgtaaaaacggcgtattaatttctaatgcgacaggcaaagcacttggctatgcattatttggcttacaagaacgtggtaagttaatgattgatgcaaacgtagaagtttatgaagggcaaattatcggtattcatagccgctcaaatgacttaaccgtaaactgcttgcaaggtaaaaaactaactaatatgcgtgcgtcaggtaaagacgatgcgattgtgctaactacacctgtaaaattcagtcttgaacaagcgattgaatttatcgatgatgatgaactagtggaagtaacacctgagtcgattcgtatccgtaaaaaacttttaacggaaaacgatcgtaaacgtgcaaatcgtacaacaacaagtactagcacgcattaa

SEQ ID NO: 691 - protein, 520 aa, H. influenzae
MVDSVLLVVDAFDGPMPQTRFVTQKAFAHGLKPIVVINKVDRPGARPDWVVDQVFDLFVNLGASDEQLDFPIIYASALNGVAGLEHEDLAEDMTPLFEAIVKYVESPKVELDAPFQMQISQLDYNNYVGVIGIGRIKRGSIKPNQPVTIINSEGKTRQGRIGQVLGHLGLQRYEEDVAYAGDIVAITGLGELNISDTICDINAVEALPSLTVDEPTVTMFFCVNTSPFAGQEGKYVTSRQILERLNKELVHNVALRVEETPNPDEFRVSGRGELHLSVLIENMRREGYELAVSRPKVIYRDIDGKKQEPYEQVTIDVEEQHQGSVMEALGIRKGEVRDMLPDGKGRVRLEYIIPSRGLIGFRGDFMTMTSGTGLLYSSFSHYDEIKGGDIGQRKNGVLISNATGKALGYALFGLQERGKLMIDANVEVYEGQIIGIHSRSNDLTVNCLQGKKLTNMRASGKDDAIVLTTPVKFSLEQAIEFIDDDELVEVTPESIRIRKKLLTENDRKRANRTTTSTSTH

SEQ ID NO: 692 - DNA, 4146 bp, H. influenzae
atggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatccggataatgttaccattagcaatggtaacgatgatcaatctcaattaaaggacgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatggggtttttaaatattaccgctgggggttctgtagcttttgaaaaggcagggggtgataaaggccgtgctgcaagtgatgctaaaattgttgctcagggtgtaattactgcaggcagtggtcaagatttccgttttaataatgtatcactaaatggaactggtagagggttgaaattcattacagctaaaggaaataaaggtaatttctcagccaaatttgatggtgtgttaaatatttcaggtaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttaactgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtggaagtaaccgctaaaacaggtgacattaaaggtggaattgagtccaagtctggcggagtaacacttactgcaaccggagatactcttgctgtaggtaatatttcgggtaacactgttagtgttactgcaaatagcggtacattaaccaccaaagcagactctacaatcaaaggaaccgggagcgtaaccaccttaagtcaatcaggcgatatcggcggtacgatttctggtaagacagtaagtgttacagcaaccaccgacagtttaactgttaaaggtggcgcaaaaattaatgcgacagaaggaactgcaaccttaactgcatcatcgggcaaattaaccaccgaggctagctcaagcatcacttcagccaagggtcaggtagacctttcagctcgggatggcaatattggaggaagtattaatgctgctaatgtgacattaaataccacaggcactttaactaccgtgaagggttcaagcattaacgcaaacagcggcaccttggttattaacgcagaagacgctaagctagatggtacggcatcaggtgaccgcacagtagtaaatgcaactaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcagtag

SEQ ID NO: 693 - protein, 1381 aa, H. influenzae
MVQFLQESSNSAVFNRVTSDQISQLKGILDSNGQVFLINPNGITIGKDAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAANIRNQGKLSADSVSKDKSGNIVLSAKEGEAEIGGVISAQNQQAKGGKLMITGDKVTLKTGAVIDLSGKEGGETYLGGDERGEGKNGIQLAKKTSLEKGSTINVSGKEKGGRAIVWGDIALIDGNINAQGKDIAKTGGFVETSGHYLSIGNDAAVEAKEWLLDPDNVTISNGNDDQSQLKDDRGDSPNKILADNKHTVNNKTLSTALAKGIGVNISAKKKVNVTADINVHNGTLTLHSEQGGVEINGDITSEQNGNLTIKAGSWVDVHKNITIGMGFLNITAGGSVAFEKAGGDKGRAASDAKIVAQGVITAGSGQDFRFNNVSLNGTGRGLKFITAKGNKGNFSAKFDGVLNISGNISINHTANNQLSYFHRQGYTYWNLTQLNVDSDSSFSLTSIKDAIKVGGYDNAKDKKNTGGIGFTRDTIFNVKQGARVDISYTLPISPVKNSRIAAVNFDGNITVKGGGVVNLKFNALSNNYKTPGVNISSRFINVTEGSQLNITGSMPSTTLFNVANDLIINATNSFVSIKEIEGTDTHLDTGLKVNGNVTIKGGNVTLGSNKAKTKFDKNVTVEKGANLTLASANFGNHKGALTVAGNINTQGKLVATGDTIDVSGDFTVGNDATFNGNTNNNLNITGNFTNNGTSIIDVKKGAAKLGNITNEGSLNITTHANTNQKTIITGNITNKKGDLNIRDNKNNAEIQIGGNISQKEGNLTISSDKVNITKQITIKAGVNGENSDSGTENNANLTIKTKTLELTNNLNISGFHKAEITAKDNSDLIIGKASSDSGNAGAQKVIFDKVKDSKISAGNHNVTLNSEVETSNGNSNAAGDSNGNNAGLTISAKDVAVNNNITSHKTINISATTGNVTTKEGTTINATTGGVEVTAKTGDIKGGIESKSGGVTLTATGDTLAVGNISGNTVSVTANSGTLTTKADSTIKGTGSVTTLSQSGDIGGTISGKTVSVTATTDSLTVKGGAKINATEGTATLTASSGKLTTEASSSITSAKGQVDLSARDGNIGGSINAANVTLNTTGTLTTVKGSSINANSGTLVINAEDAKLDGTASGDRTVVNATNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 694 - DNA, 2349 bp, H. influenzae
atgacaaaaaaacgtaaaaacttaatcagccaagatcctcattacaaacgagaattggaaaaatacggcaatccaatcccgagccgtgaatttattttaagcgttattcgagacaataatgcaccgatgaatcgggatgaaattttgaccgcactttccattcgaaatgaagagcaaatagaagcgatgcgtcgccgattacgcgcgatggaaaatgatggccaattagtgttcaccaaacgtaaacgctatgccttaccagaaaaattagatttatttaaaggcacggtaattggtcatcgcgaaggttttggttttttacaggtcgatggcaaaaaggatgatttattcattccaaaccatcaaatgcaaagagtcatgcatggagattttgtcttagcgcaacttgctggattagatcgtcgtggtcgccgtgaagtgcgaattgtgcgcgtattagaaagccgtaaaaaacaaattgtgggtcgttttttcttagaaaacggttttagctatgtggtgcctgatgacagcagaattggtcgagatattctcgtgccaaatgaacatcgtaatggtgctcgcatgggacaagttgtggttgtcgagttgcaagaacgttctgccagttttaaccagccaattggcgtaatcacagagatcctaggcgataatatggcgaaagaaatggaagtggaaatcgccttgcgtaaccacgatattccccataagtttccaagtgcggtggaaaaatacgtaaaaaaattcactgaagaagtgcctgaagaagcaaaaaaaggccgtgtggatttacgaaatttaccgcttgtgaccattgatggtgaagatgcgcgggattttgacgatgccgtttattgtgaaaaacacggcaaaggctggaaactttgggtggcgattgcggatgttagttattacgtacgtttacgttccgctttggatgtggaagcgcataatcgtggtaactcggtctattttccgaaccgagttgtacctatgctacccgaaattttatcgaacggcttatgctctctaaacccacaagtggatcgtttgtgtatggtgtgtgagatgcaaatttctgccaaaggtaagctcatagattatcgcttttatgaagcagtgatgaattctcacgcccgcctcacttatacaaaagtagcaaaaatgcttgaaggcgatgaagaattacgcgctcgttattctacgcttgtgcctcatttagaagatctttataaactctatcaagcgttgcttggtgcacgtcatcaacgtggtgcgatcgattttgaaaccattgaaactaagtttatttttaatgcaatggggagaattgagcgtattgaacccgttgttcgcaatgatgcccacaaaatcattgaggaatgtatgattcttgcgaatatcgcagcagctaattttatggaaaaacataaagaacctgcattatatcgcattcatgccaccccgagcgaagaaaaattaacatcgttccgcactttcttaagtgagtttggtttaaccttagaaggtggattgaagccaaccacaaaagactatgctgctctcttagaaaaagttaaagaacgacatgatcatgaacttattcaaacaatgttgctacgttcattaagtcaagccgtctatcatgctgataatattgggcattttggtttggctttggaagaatatgcacactttacttcgccaattcgccgttatccagacttaacacttcatcgaggtatcaagtatttactcgctaaagaacaaggcgcaaaacgtaaaaccaccgatacaggcggttatcattactcttttgatgaaatggatttacttggcaatcactgttcaatgacggaacgccgtgccgacgacgccactcgtgaagtggcagattggctgaaatgcgaatatatgcaagatcatgttggcggtgaatttagcggtgttatttcatctgtgactggatttggtttatttgtacgcttagatgatttattcatcgatggtttagtccatatttccaccttagaaaacgattattaccaattcgatgcagcaaaacagcgtttaattggcgaaaatagcggaatgcaatatcgcttaggcgataaagttcgtatcaaagttgaagcagtacatttagaaaataaaatggtcgatttctcgctgatggggagtgaacgtaaacctcgtcgtgctggaaaaacggcgaaagaaaaagccaagaaagtctttaaagaactaccgtctaaaacatcccagaaacgaaaaagtgcggtaaaaaagaaagatgttttgaagaaagcatctagaaaacgaaaataa

SEQ ID NO: 695 - protein, 782 aa, H. influenzae
MTKKRKNLISQDPHYKRELEKYGNPIPSREFILSVIRDNNAPMNRDEILTALSIRNEEQIEAMRRRLRAMENDGQLVFTKRKRYALPEKLDLFKGTVIGHREGFGFLQVDGKKDDLFIPNHQMQRVMHGDFVLAQLAGLDRRGRREVRIVRVLESRKKQIVGRFFLENGFSYVVPDDSRIGRDILVPNEHRNGARMGQVVVVELQERSASFNQPIGVITEILGDNMAKEMEVEIALRNHDIPHKFPSAVEKYVKKFTEEVPEEAKKGRVDLRNLPLVTIDGEDARDFDDAVYCEKHGKGWKLWVAIADVSYYVRLRSALDVEAHNRGNSVYFPNRVVPMLPEILSNGLCSLNPQVDRLCMVCEMQISAKGKLIDYRFYEAVMNSHARLTYTKVAKMLEGDEELRARYSTLVPHLEDLYKLYQALLGARHQRGAIDFETIETKFIFNAMGRIERIEPVVRNDAHKIIEECMILANIAAANFMEKHKEPALYRIHATPSEEKLTSFRTFLSEFGLTLEGGLKPTTKDYAALLEKVKERHDHELIQTMLLRSLSQAVYHADNIGHFGLALEEYAHFTSPIRRYPDLTLHRGIKYLLAKEQGAKRKTTDTGGYHYSFDEMDLLGNHCSMTERRADDATREVADWLKCEYMQDHVGGEFSGVISSVTGFGLFVRLDDLFIDGLVHISTLENDYYQFDAAKQRLIGENSGMQYRLGDKVRIKVEAVHLENKMVDFSLMGSERKPRRAGKTAKEKAKKVFKELPSKTSQKRKSAVKKKDVLKKASRKRK

SEQ ID NO: 696 - DNA, 786 bp, H. influenzae
atgatcgtcaattttatttctgctttaggaaaacaggtgatcgactttttccgtgcattggggcgagcaggctttatgttatttggtgcattgatcggcaagccacaaattcgtaagcattttcctttgcttgtgaagcaaatgcatgttttaggtgtccaatcgttactcattattttgttgtccggtttatttattggaatggtattaggactacaaggttatgtcgtattagttgatttttctgctgaaacaagtttaggtcagttggtggcactttctcttttgcgagaattagggcctgttgttaccgcacttttatttgctggtcgagcaggttctgcattgacggctgaaataggcttaatgaaagccactgaacaactttctagtcttgaaatgatggctgttgatcctttacgtcgagtgattgcacctcgtttttgggcaggggttatttccatgccaattttgtcaatcttgtttatcgcgattggtatttggggcagttccttagtaggtgtggattggaaaggtgttgattcaggcagcttttggtctgttatgcaaaattccgtgagttggagctatgatattttaaatggctttattaaagcggttttctttgctgtagccgtaacttggattgcactttttaatggttatgattgtatgccaacatcagaaggtatcagccaagctacaacacgaacagttgtgcacgcttcacttgttgttctaggattagattttattttgactgctattatgtttggcgcaagttaa

SEQ ID NO: 697 - protein, 261 aa, H. influenzae
MIVNFISALGKQVIDFFRALGRAGFMLFGALIGKPQIRKHFPLLVKQMHVLGVQSLLIILLSGLFIGMVLGLQGYVVLVDFSAETSLGQLVALSLLRELGPVVTALLFAGRAGSALTAEIGLMKATEQLSSLEMMAVDPLRRVIAPRFWAGVISMPILSILFIAIGIWGSSLVGVDWKGVDSGSFWSVMQNSVSWSYDILNGFIKAVFFAVAVTWIALFNGYDCMPTSEGISQATTRTVVHASLVVLGLDFILTAIMFGAS

SEQ ID NO: 698 - DNA, 1401 bp, H. influenzae
atgcaaatgaaagcaaataaagcgttctatgttattggtgggattaccgctcttgtcgtgacgctgatggctggatttcttttctccggtagtagttcaacaaatacagcagaaaccaagaaagaagatactttagatatctcttttaaagatttatcaccggaagaattacgagcaatggggattgagggtgacacatctaaagatacggtaagaacacttataggtaaagtgaaagagcataataagcgatttgatgaagtgattttacaaaatgaacgcttggtaaaagagaatgagcagttaaaaaatcaagcaaacaatacggattatcaaattcaacaggcggtacaagcagaaacaggggcgttaattaatgagattaatgcgttaaaagatcaggttgtacaagctggtaatcaagttgtagggaatggaaatgcccaggcaaatcccaatgctcctctaccaataaacggagcaacaactggccctcaggttgaaactcgagggggaattaattgggtgaaccctagtgatatgccaactacagacagacaagggaatgctctacaaggtattggtgtaaatggtgcaggaatcggttttcccaaaaccttcgataacaatgtgaatgacatccgaaaatctaatgatgggttgcaatctagtacaggtaataatgcaatatttaataccgctacaccatttttcacaattgcagctaactctactttaactaattctgttgctatgactgcgcttgttgggcgtgtgccgattgacaataaggtaaccgagccttatccgtttaaattgcttattggtcgagataacttaattgcaaatggcattgaactgccggatattgaaggcgcaattgtctctggaacagcaagcggtgactggacgctatcttgtgttcgtggtgatgtgaaaagcttaacttttgtgtttagcgatggccgcattgtttcaacagacaattctgacgataaaattggctggttatctgatccacatggtgtgccttgcattcctggagaacgcagaacaaatgctccggaatatctaacgaccaacttcttcttaacgggggcttcagcagctgcacaaggcttatcatcttctcaatcaacaacagtggttgatggcggtgcagtaattggtgcggtaacgggtaataacggtaagtatattcttggtcaagcgttaggtggcggtttgagagaaacagcagactggttccgtcagcgttatggccaaatgtttgatgcggtatatgttccaccgggtaaagaagtggctgtacacatcgaaaaacaaattgatattgattatgaccgcatgtctcgaaaagtgaaatacggacaagcctcaagacaatctaacttggattaa

SEQ ID NO: 699 - protein, 466 aa, H. influenzae
MQMKANKAFYVIGGITALVVTLMAGFLFSGSSSTNTAETKKEDTLDISFKDLSPEELRAMGIEGDTSKDTVRTLIGKVKEHNKRFDEVILQNERLVKENEQLKNQANNTDYQIQQAVQAETGALINEINALKDQVVQAGNQVVGNGNAQANPNAPLPINGATTGPQVETRGGINWVNPSDMPTTDRQGNALQGIGVNGAGIGFPKTFDNNVNDIRKSNDGLQSSTGNNAIFNTATPFFTIAANSTLTNSVAMTALVGRVPIDNKVTEPYPFKLLIGRDNLIANGIELPDIEGAIVSGTASGDWTLSCVRGDVKSLTFVFSDGRIVSTDNSDDKIGWLSDPHGVPCIPGERRTNAPEYLTTNFFLTGASAAAQGLSSSQSTTVVDGGAVIGAVTGNNGKYILGQALGGGLRETADWFRQRYGQMFDAVYVPPGKEVAVHIEKQIDIDYDRMSRKVKYGQASRQSNLD

SEQ ID NO: 700 - DNA, 441 bp, H. influenzae
atgaacaaccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataacgaatttcatgtctatgaatttatgacgcatagcggcaattacctttttatggcattggattccacaacacaaaatataaatacaaaagattggtcaaatttacctattgtcggcaccgtaaccaatacgattcatcaaatgaaacgtcgcaataaaatgaaatgggcagcgtag

SEQ ID NO: 701 - protein, 146 aa, H. influenzae
MNNQTLATQYEMDFSYNPLPFFSDIEDNLKFNKKLDLNLYCIKRPKQTCFIHITNPNMLAWGIESGDMLVVEKNDDLYSGDLVVLEENNEFHVYEFMTHSGNYLFMALDSTTQNINTKDWSNLPIVGTVTNTIHQMKRRNKMKWAA

SEQ ID NO: 702 - DNA, 609 bp, H. influenzae
atgactatggtattagtaacccgtcaagcaccagattttacttcatctgctgtattaagcaatggcgaaatcgttgataacttcaactttaaaaaacacattgctggaaaagctgcagtaatctttttctacccattagactttacctttgtttgcccttctgagttaatcgcatttgaccaccgttatgaagaattcaaaaaacgtggcgtagaagtagttggtgtttctatcgactctcaattcactcacaatgcatggcgtaacaccccaactgaaaatggtggtatcggtcaagttaaatatgcattagcggcagacgtaaaacacgaaattgctcaagcatacggtattgaacatccagaagcaggcgttgcattacgcgcttcattcttaatcgacaaaaatggcgttgttcgtcaccaagtagtaaacgatcttccattaggtcgtaatatcgatgaaatgttacgtatggttgatgcattacaattccatgaagatcacggtgaagtttgccctgctcaatgggaaaaaggtaaagaagggatgaaagataaccctgaaggtgttgcaaaatacttaaaacaaaacgctgataaactttaa

SEQ ID NO: 703 - protein, 202 aa, H. influenzae
MTMVLVTRQAPDFTSSAVLSNGEIVDNFNFKKHIAGKAAVIFFYPLDFTFVCPSELIAFDHRYEEFKKRGVEVVGVSIDSQFTHNAWRNTPTENGGIGQVKYALAADVKHEIAQAYGIEHPEAGVALRASFLIDKNGVVRHQVVNDLPLGRNIDEMLRMVDALQFHEDHGEVCPAQWEKGKEGMKDNPEGVAKYLKQNADKL

SEQ ID NO: 704 - DNA, 741 bp, H. influenzae
atgacaaacaaagtaaacagttatggctggaaagccttaattggctctgccgtaggctatgcaatggacggtttcgatcttctcattttaggtttcatgcttagtgcaatttccgcagacttaaatctaacacccgcccaaggtggatctctcgtaacttggactctgattggtgccgtatttggcggcattttatttggtgcattaagcgataaatacggtcgtgtacgcgtactgacttggactattcttctttttgcggtgtttactggtttatgtgcgattgcacaaggttattgggatttactgatttatcgcacaattgctggtattggcttaggcggtgaatttggaattgggatggctctagcagcagaagcatggcctgcacgccaccgagcgaaagcagcatcttatgttgcattgggttggcaagttggtgtgttaggtgctgcgttgcttacaccattattgctcccgcatattggctggcgtggaatgttcttagtgggtatcttccctgcatttgtcgcttggttcttacgttctcatctgcacgaacctgaaattttcactaaaaaacaaaccgcactttcaacgcaatccagctttactgataaattacgttcattccagcttctgattaaagacaaagccacgagcaaaattagtcttggtatcgtcgtactcacttcctgtacaaaacttcggttattacggcattatgatttggttacctaa

SEQ ID NO: 705 - protein, 246 aa, H. influenzae
MTNKVNSYGWKALIGSAVGYAMDGFDLLILGFMLSAISADLNLTPAQGGSLVTWTLIGAVFGGILFGALSDKYGRVRVLTWTILLFAVFTGLCAIAQGYWDLLIYRTIAGIGLGGEFGIGMALAAEAWPARHRAKAASYVALGWQVGVLGAALLTPLLLPHIGWRGMFLVGIFPAFVAWFLRSHLHEPEIFTKKQTALSTQSSFTDKLRSFQLLIKDKATSKISLGIVVLTSCTKLRLLRHYDLVT

SEQ ID NO: 706 - DNA, 501 bp, H. influenzae
atgatttggttacctaatttcttatcaaaacaacttggattcagtttaactaaatctgggctttggaccgccgttaccgtctgcggcatgatggctggcatttggattttcggacaactcgccgaccgaatcggacgcaaaccaagtttcttacttttccaattaggcgcagtgataagtatcgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggcgcagttgtacttgcttactctttccaaacggccatcgctctacttgcgattatctacgtaattgatatgttagcgacaattttcttaatccctgaattaaaaggtaaagccttagactaa

SEQ ID NO: 707 - protein, 166 aa, H. influenzae
MIWLPNFLSKQLGFSLTKSGLWTAVTVCGMMAGIWIFGQLADRIGRKPSFLLFQLGAVISIVVYSQLTDPDIMLLAGAFLGMFVNGMLGGYGALMAEAYPTEARATAQNVLFNIGRAVGGFGPVVVGAVVLAYSFQTAIALLAIIYVIDMLATIFLIPELKGKALD

SEQ ID NO: 708 - DNA, 645 bp, H. influenzae
atgagtaacttaaaagggattgttcatcaaaaaaatcgcgaaatcatgaccgggcgaattgctatcggtgcattgcttgtgatttgtttggtgctatgtgccattatttttaccgcaccaagtcgattaatgatttataacccaccggatttacgtgcgggaagtcaacgcccttggtgggaagtgccaaaatcaaccgtttatgcctttgcttatcaaaccttccagcagttaaaccgctggatggagaatggcgaggaagaatacaaattaaatattgaaagaaataaagcctttattacgccaagttgccaagaatttttgaagaaagactactatgaccgtttatctaacggtgaattacgtgaacgtgcacgtggtgtttatgaaattgtgggacgtggatttaaagacagtagcgttattgtgcatagtccagatagctggacggttaatcttgatttaagtgtagatgagtatttcaaagatgaaccagtaaaacgtgttttaacccgcttcccggtcaatatcgtgcgcatggaaacagatttacagaacaatccttggggattgggatttaactgctacagctcaattccattacgtttagaagcaaaagaatttagagaaggggataaccaataa

SEQ ID NO: 709 - protein, 214 aa, H. influenzae
MSNLKGIVHQKNREIMTGRIAIGALLVICLVLCAIIFTAPSRLMIYNPPDLRAGSQRPWWEVPKSTVYAFAYQTFQQLNRWMENGEEEYKLNIERNKAFITPSCQEFLKKDYYDRLSNGELRERARGVYEIVGRGFKDSSVIVHSPDSWTVNLDLSVDEYFKDEPVKRVLTRFPVNIVRMETDLQNNPWGLGFNCYSSIPLRLEAKEFREGDNQ

SEQ ID NO: 710 - DNA, 960 bp, H. influenzae
atgcaatcaatcaatcaatcaatcaatcaatcaatcaatcaatcaatcaatcaatcaatcaatcaaattgtaggatttgttaaaacttgctacaagcctgaagaagtatttcattttcttcatcagcattccattcctttttcctccattggaggaatgaccaatcaaaatgttctacttaatatttctggagttaagtttgtattacggatccctaatgccgtaaatttatcacttataaatcgagaatatgaggcattcaataatgctcaggcatatcgtgctggcttgaatgtagaaactcccgtattagatgccaaaagtggcgtaaaactgactcgttatttagaaaatagtaatactttaagccagatacaattaaacgaacaaagttgtttgtctcaagttgtgaataatttatatcgtttacacaatagtgaatttgttttccgtaatgtatttagcgtattcgatgagtttcgccaatatttttcattgctagaaaacaaatccgctttttatcaagctgattctagaatggataaactttcagctgtattttggcaatttgaagaaatcaataaagagataattttacgtccgtgccacaatgatttagtccctgaaaatatgttattacaagatgatcggctattttttatcgattgggaatattcgggcttaaatgatccgctatttgatatagctactatcattgaggaagctcatttatcgaaagaagctgctgattttctattagaaacctattgcaatcagacaaataaatatcacaagacagaatttcaaatcgctcacaaacggttaaaaatccatcgcttttgccaaaatgtattgtggtttttatggacaaaagtaaaagaagaacacggcgagaattttggcgattatgcattaaaacgcttagacgcagcatttaaactgttagaggaattgccataa

SEQ ID NO: 711 - protein, 319 aa, H. influenzae
MQSINQSINQSINQSINQSINQIVGFVKTCYKPEEVFHFLHQHSIPFSSIGGMTNQNVLLNISGVKFVLRIPNAVNLSLINREYEAFNNAQAYRAGLNVETPVLDAKSGVKLTRYLENSNTLSQIQLNEQSCLSQVVNNLYRLHNSEFVFRNVFSVFDEFRQYFSLLENKSAFYQADSRMDKLSAVFWQFEEINKEIILRPCHNDLVPENMLLQDDRLFFIDWEYSGLNDPLFDIATIIEEAHLSKEAADFLLETYCNQTNKYHKTEFQIAHKRLKIHRFCQNVLWFLWTKVKEEHGENFGDYALKRLDAAFKLLEELP

SEQ ID NO: 712 - DNA, 1626 bp, H. influenzae
taactctcgccgctgcaactcttgttttggcagcttgtgatcaatctagcttcggcaaataaatctactgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagctgggaaattagcgatgatggtttaagttatacttttcatttaagaaagggtgttaaattccatacaacaaaagaatttaccccgacacgtgattttaatgcagatgatgttgtattttcattccaacgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaataa

SEQ ID NO: 713 - protein, 540 aa, H. influenzae
LSPLQLLFWQLVINLASANKSTAQTEAKSSSNNTFVYCTAKAPLGFSPALIIEGTSYNASSQQVYNRLVEFKKGSTDIEPALAESWEISDDGLSYTFHLRKGVKFHTTKEFTPTRDFNADDVVFSFQRQLDPNHPYHNVSKGTYPYFKAMKFPELLKSVEKVDDNTIRITLNKTDATFLASLGMDFISIYSAEYADSMLKAGKPETLDSRPVGTGPFVFVDYKTDQAIQYVAHENYWKGRTPLDRLVISIVPDATTRYAKLQAGTCDLILFPNVADLAKMKTDPKVQLLEQKGLNVAYIAFNTEKAPFDNVKVRQALNYAVDKKAIIEAVYQGAGISAKNPLPPTIWSYNDEIQDYPYDPEKAKQLLAEAGYPNGFETDFWIQPIIRASNPNPKRMAELIMADWAKIGVKTNPVTYEWADYRKRAKEGELTAGIFGWSGDNGDPDNFLSPLLGSSNIGNSNMARFNNSEFDALLNEAIGLTNKEERAKLYKQAQVIVHNQAPWIPVAHSVGFAPLSPRVKGYVQSPFGYDAFYGVSVDGK

SEQ ID NO: 714 - DNA, 1074 bp, H. influenzae
atggcgaaaattgatcgcttggtaaatgtggctattgatttaaatacaaccacaatcgccggtaaatcttttagtgatttattaattttaggcgaacatacgctgaataattcagcacgtttgctggtagtcaccgatccaaatgaattattggatttaggcttaaaatcaaacaatccgctttatatcgctgtggctaccgcctttgcgcagccgtcacacgtggcacaggtatttatcggacgtaaagcacaagatgaaagcgtgacggatgcgcttgctgcggtcgcacgagaaaataacagctggtatggcttggcgttggtctcgcgtgaagacgctgatgtgatgttggcggcggcgtgggcagaaaccaatggtaaattatttgttaccgcctctgctgatgaaaaattgccacaatcggcggagaaaaccgatattgcgagcaaacttgaagcgaaacaatattaccgctcggcggtaatgtattcccataaagcaacggaagaatacccagaaattgccttaatgagctattccttcacattctatccggggtcagaaacgtggaacttgaaaaaacttgctggcgtatcttattcgccgttaatggaaggcgaatacttagcttgctcgaagaaaaacgcaacgacatttgagaaatttaacgatagctttgcggtaacgcaaggcggcaaagtcgcagctggggaatggatcgatattatccgtttccgtgattggttggtgcaggaagtgcaaattaatgtgacatccgtcttaatcaatgcttacggtaaagtgccttacaccgataaaggtattcaattaattggtgcagcagtgcgtcaggcgttagatttaggtgtagcacgtggcggtattgcgccgacagaattggatgataataacaaggaaattccaagttatgtgatttcccttccactggcggcaaaggtatcgaataacaataaaggtaagcgtttattgcaagatgtgaaatttacggcacgtttagccggtgctattcacttgacagaaatcaagggcaatctggcttacagtctttaa

SEQ ID NO: 715 - protein, 357 aa, H. influenzae
MAKIDRLVNVAIDLNTTTIAGKSFSDLLILGEHTLNNSARLLVVTDPNELLDLGLKSNNPLYIAVATAFAQPSHVAQVFIGRKAQDESVTDALAAVARENNSWYGLALVSREDADVMLAAAWAETNGKLFVTASADEKLPQSAEKTDIASKLEAKQYYRSAVMYSHKATEEYPEIALMSYSFTFYPGSETWNLKKLAGVSYSPLMEGEYLACSKKNATTFEKFNDSFAVTQGGKVAAGEWIDIIRFRDWLVQEVQINVTSVLINAYGKVPYTDKGIQLIGAAVRQALDLGVARGGIAPTELDDNNKEIPSYVISLPLAAKVSNNNKGKRLLQDVKFTARLAGAIHLTEIKGNLAYSL

SEQ ID NO: 716 - DNA, 678 bp, H. influenzae
atgaaagaagtttctctagtaaaaaattatactcctaaagaatatcagcagcatgcatcttgccctcatagtcaaatttctaaaaataaaatggtattaggcatcagttttgcaattattaccttttatatggttgttgaatttctagggggatattggtttaacagccttactttgatggctgatgctgggcatatggcaaatgatagtttatctatttttttagcatggattgggttatttttaagtctaaaatggcaaaaatggttagctttaatcaatggaatttcattagtttgggtcgctatttggatttttattgaggctgtaacacgttggcaggctccgatagaaatagccgctttgccaatgttaggtgtagctttactagggtttgggattaatttgttggtagcttttataatgctaaaaagtaatcgccataatttgaatattcgtgcagcatatttgcatgttttagtagatttatttggttcggttgttgctattattgcaggaataagtgcttggtggttaaattggcagtgggttgatgtagttgctagtggtatcttaagcatttttgtattacaaagcggtatttctacagtttttcaagctattaaatccttatatagtagcgatgacaattcattgccgaatgatcattctcattaa

SEQ ID NO: 717 - protein, 225 aa, H. influenzae
MKEVSLVKNYTPKEYQQHASCPHSQISKNKMVLGISFAIITFYMVVEFLGGYWFNSLTLMADAGHMANDSLSIFLAWIGLFLSLKWQKWLALINGISLVWVAIWIFIEAVTRWQAPIEIAALPMLGVALLGFGINLLVAFIMLKSNRHNLNIRAAYLHVLVDLFGSVVAIIAGISAWWLNWQWVDVVASGILSIFVLQSGISTVFQAIKSLYSSDDNSLPNDHSH

SEQ ID NO: 718 - DNA, 1017 bp, H. influenzae
atgaacactcgtcccttttatttcggacttatatttattgcgattatcgctatacttgctcactatttaggaaacactgatttttcccatcattatcatatcagtgctctaattattgccatcttgctgggaatggcaatcggcaataccatttatccgcaattttcaacacaagtggaaaaaggcgtgttatttgcgaaaggcacgcttcttcgcactggcattgtgctgtatggttttcgccttacttttggcgatattgccgatgttggcttaaatgctgttgtcactgatgcgattatgctaatttcaaccttttttcttaccgcacttttgggcattcgttatctaaaaatggataaacaattggtttatctcactggggctggatgtagtatttgtggtgcggcagcggttatggcggcagagcctgttaccaaagcagaatctcataaagtttcagtagcgattgccgtagtggtcattttcgggacgcttgctatttttacttaccccttgttctacacgtggtcacaagatttaattaacgcccatcaattcggtatttatgttggttctagtgtacacgaagtggctcaagtgtatgcgattggggaaaatattgatcctatcgtggcgaatactgccgtcatttccaaaatgatccgagtgatgatgctcgcaccatttttattaatgctttcttggttattaacacgtagtaatggagtatcagaaaatacatcacacaaaattacaattccttggtttgctgtactttttattggcgttgcgatttttaattcttttgatttattaccaaaagaactcgtgaaattattagttgaaatcgattctttcttattaatttcagcgatggctgcccttggcttaacgacacaagcaagcgcaatcaaaaaggcaggattaaaaccacttgttttaggaacactaatttatttatggctaatggttggtggatttttagtgaattatggaatatcaaaattaatataa

SEQ ID NO: 719 - protein, 338 aa, H. influenzae
MNTRPFYFGLIFIAIIAILAHYLGNTDFSHHYHISALIIAILLGMAIGNTIYPQFSTQVEKGVLFAKGTLLRTGIVLYGFRLTFGDIADVGLNAVVTDAIMLISTFFLTALLGIRYLKMDKQLVYLTGAGCSICGAAAVMAAEPVTKAESHKVSVAIAVVVIFGTLAIFTYPLFYTWSQDLINAHQFGIYVGSSVHEVAQVYAIGENIDPIVANTAVISKMIRVMMLAPFLLMLSWLLTRSNGVSENTSHKITIPWFAVLFIGVAIFNSFDLLPKELVKLLVEIDSFLLISAMAALGLTTQASAIKKAGLKPLVLGTLIYLWLMVGGFLVNYGISKLI

SEQ ID NO: 720 - DNA, 1851 bp, H. influenzae
atgttaaaccgttatccattatggaagaatttgatggttatttttattgtggccatcgggattttatattctcttccaaatatttatggtgaagatcctgcggtgcaaatttccggtacgcgcggtcaagaagcaaatactagcgtgcttggacaagttcaagatgtgcttaaaaccaataatcttccaaccaaatctatcgtgcttgagaatggctcaattctagctcgttttactaataccgatgatcaacttcttgctaaagataaaattgctgaacgtcttggcaataattacaccaccgcattaaatcttgctccagccactccagcttggttaagtatgtttggtgcgaatcctatgaaatggggattagacttacgcggtggggttcgttttttgatggaagtcgatatgaatgccgcacttgtaaaacgccaagagcaattacaagacagtttgcgtggcgaacttcgcaaagaaaaaattcaatatactgccattaaaaatacagagcattttggtacgttgataaccttagctaatgtgagccagcgtgctaaagctgagcgaattattcgccaattacatccaacattagacattactgagcctgatgctgatagtattaatttagggctatctactgcagcattaaatgaagcacgcgacttagccattgagcaaaacttaacgattttacgtaaacgtgttgctgaattaggtgttgcagaagcggtaattcaacgtcaaggtgctgaacgtattgtgattgaattaccaggtgttcaagacactgcacgcgcaaaagaaattttaggggcaacggcaacacttgagtttcgtatcgtaaatcaaaatgttacagctgatgctatttctcgtaatatgttaccagctgattcggaagttaaatatgatcgccaagggcatcctgttgcattatttaaacgtgccgtattaggtggggagcatatcattaattcaagctctggtttagatcagcattcaagcacgccgcaagtgagtgtaaccttggatagcgaaggtggcgagattatgtctcagaccactaaaaaatattacaaaaaaccaatggcaacgctttatgttgaatataaagataatggcaaaaaagatgaaaatggcaaaaccattttagaaaagcatgaagaagttattaatgttgcaacaattcaaggtcgttttggttctaatttccaaattactggtgttgatagtattgccgaagcacataatctttctaccttgttgaaatctggcgcattaattgcaccaattcaaattgttgaagaacgcacaattggcccatcattaggtgcacaaaacgtagagcaagggattaatgcgagtctttggggattagttgctgttattgcctttatgttgttttactacaaaatgtttggtgtgattgcaagttttgcacttgttattaatatcgtattacttgtgggattaatgtctattttacccggtgcgacactttcaatgccgggtattgcgggtatcgttttaactttaggtatgtcagtagatgcgaatgtattgatttttgaacgtattaaagaagaaattcgtaatggtcgttcaattcagcaagccattaatgaaggttataacggtgcatttacttctatttttgatgctaacttaaccacaatcttaaccgcaattattctatacgcggtaggaacaggcccaattcaaggttttgcgattacgctttcacttggtgttgcgatttctatgtttaccgcgattactggaactcgcgcattagttaatgccctttacggcggcaaacaacttaaaaaattattaatttag

SEQ ID NO: 721 - protein, 616 aa, H. influenzae
MLNRYPLWKNLMVIFIVAIGILYSLPNIYGEDPAVQISGTRGQEANTSVLGQVQDVLKTNNLPTKSIVLENGSILARFTNTDDQLLAKDKIAERLGNNYTTALNLAPATPAWLSMFGANPMKWGLDLRGGVRFLMEVDMNAALVKRQEQLQDSLRGELRKEKIQYTAIKNTEHFGTLITLANVSQRAKAERIIRQLHPTLDITEPDADSINLGLSTAALNEARDLAIEQNLTILRKRVAELGVAEAVIQRQGAERIVIELPGVQDTARAKEILGATATLEFRIVNQNVTADAISRNMLPADSEVKYDRQGHPVALFKRAVLGGEHIINSSSGLDQHSSTPQVSVTLDSEGGEIMSQTTKKYYKKPMATLYVEYKDNGKKDENGKTILEKHEEVINVATIQGRFGSNFQITGVDSIAEAHNLSTLLKSGALIAPIQIVEERTIGPSLGAQNVEQGINASLWGLVAVIAFMLFYYKMFGVIASFALVINIVLLVGLMSILPGATLSMPGIAGIVLTLGMSVDANVLIFERIKEEIRNGRSIQQAINEGYNGAFTSIFDANLTTILTAIILYAVGTGPIQGFAITLSLGVAISMFTAITGTRALVNALYGGKQLKKLLI

SEQ ID NO: 722 - DNA, 1917 bp, H. influenzae
atgattgtatttagtaatctgtccttaaaacgagggcaaacggagcttctcgaaaatgcttctgctaccattaatcctaagcaaaaagtcggcttggtggggaaaaatggttgtggaaaatcttcgctttttgccttattaaaaaaagaattaacgccagagggcggcgaggtaaattatccagcaaattggcgggtatcttgggtgaatcaagaaacgcctgcattggatatttctgcaattgattatgtaattcaaggggatcgtgaatattgccgtttgcaacaagagcttgaacaagcaaatgaatgcaatgacggtaacgccattgcacgtattcacgggcaattagaaaccttggatgcgtggacaattcaatctcgtgccgcttcgttattgaatggtttaggatttagtcaagaagaaacaacccagccagtgaaagccttttcgggcggttggcggatccgtttgaatttggcacaagctctgctttgtccatcagatttattattactggatgagccaaccaaccatttggatttggatgcggttatttggttagagcgttggctagtacaatatcaaggcaccttggtattaatttctcacgatcgtgattttctcgatccgattgtgacaaaaatcctccatatcgaaaatcagaagctcaacgaatacacgggcgattattcttcctttgaagtgcaacgagccactaaattggcacaacaaacagcgatgtatcgtcagcaacaacaaaagatttcccatttacaaaaatatattgatcgctttaaagccaaagccactaaagccaaacaggcacaaagccgtatgaaagcactagaaagaatggagctgattgcaccagcttatgtggataatccttttacttttaaatttcgtccaccgcaatccttgccgaatcccttagtgatgattgaacaggcaagtgcaggttatggcagcggagaaagtgcggtagaaattttaagtaaaattaaactgaatttagtgccaggttcgcgcattggtttactcgggaaaaatggtgcaggaaaatcaaccttgattaaacttttagcgggagaactgaccgcactttcaggcacagtgcagttggcaaaaggcgtgcagcttggctattttgctcagcatcaattagatactttacgcgcagacgaatctgctctgtggcatatgcaaaaactcgcaccagaacaaacggagcaacaagttcgagattatttaggcagttttgcgtttcacggcgataaagtaaatcaagcagtgaaatctttttctggaggagaaaaagctcgtttggtgttggctttgattgtttggcaacgcccgaatttattactacttgatgaaccgactaaccatttggatttggatatgcgtcaagcattaacggaagcattggtagattacgaaggttctttggtggtggtgtcgcacgatcgtcatttattacgcaataccgtggaagaattttatttagttcacgataaaaaagtggaagaatttaaaggcgatttagaagactatcaaaaatggctgaatgaacaaaatagcacatctgaaaataaagtttcggaaaaagtgggcgataatgaaaattcggttcaaaatcgtaaggaacaaaaacgccgtgaagcagagttacgccaacaaactgcaccattacgtaaaaaaatcacgcaattagaagaaaaaatgaataaattttcttctgagcttgcgaacatagaaaatcaactggcagatactgaattatataatgcggaaaataaagaaaaattgaccgcacttttggctcaacaagtggatgtgaagaaagcattagatgatgtagaaacggaatggatgactgcacaggaagaattggaagaaatgcttcaagcgtaa

SEQ ID NO: 723 - protein, 638 aa, H. influenzae
MIVFSNLSLKRGQTELLENASATINPKQKVGLVGKNGCGKSSLFALLKKELTPEGGEVNYPANWRVSWVNQETPALDISAIDYVIQGDREYCRLQQELEQANECNDGNAIARIHGQLETLDAWTIQSRAASLLNGLGFSQEETTQPVKAFSGGWRIRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFKFRPPQSLPNPLVMIEQASAGYGSGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHDKKVEEFKGDLEDYQKWLNEQNSTSENKVSEKVGDNENSVQNRKEQKRREAELRQQTAPLRKKITQLEEKMNKFSSELANIENQLADTELYNAENKEKLTALLAQQVDVKKALDDVETEWMTAQEELEEMLQA

SEQ ID NO: 724 - DNA, 660 bp, H. influenzae
atgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgctaa

SEQ ID NO: 725 - protein, 219 aa, H. influenzae
MKLTKTLLTTALFGASIFSFQSTAWADTPEQQFQQGLTAYEQSNYQTAFKLWLPLAEQGDAQAQGGLGMMYERGLGVKQDDFKAVNWYRKAAEQGDADAQLNLGAMYAIGRGVKQDGVEAVKWFRKAAEQGNAKAQNGLGMMYDGGLGIKQDYFKAVKWHRKAAEQGYGGAQVMLGFSYLSGKGVQVNKSLAKEWFGKACDNGEQVGCEYYGKLNRGER

SEQ ID NO: 726 - DNA, 555 bp, H. influenzae
atgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgttcaagtaaataaatctttagccaaagaatggtttggtaaggcttgtgataatggtaatcaaaatggctgcgaatattatggcaagctaaatagaggggagctctaa

SEQ ID NO: 727 - protein, 184 aa, H. influenzae
MKLTKTLLTTALFGASVFSFQSTAWADTLEQQFQQGLTAYEQSNYQTAFKLWLPMAEQGYAKAQFNLGVMYAKGQGVKQDDFEAVKWFRKAAEQGYAEAKFNLGHMYSKGRGVKQDDFEAVNWYRKAAEQGDADAQAILGFLYLLGERGVQVNKSLAKEWFGKACDNGNQNGCEYYGKLNRGEL

SEQ ID NO: 728 - DNA, 552 bp, H. influenzae
atgaaactcacaaaaacacttcttaccaccgcacttttaggtgcttctgtattttcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatattgggattctcatatcttttaggaaaaggtgttcaagtaaataaatctttagctaaagaatggtttggtaaggcttgtgataatggtgatcaaggtggttgcaaatattatggcaagctaaatagaggggaacgctaa

SEQ ID NO: 729 - protein, 183 aa, H. influenzae
MKLTKTLLTTALLGASVFSFQSTAWADTLEQQFQQGLTAYEQSNYQTAFKLWLPLAEQGDANVQFNLGVMYAEGQGVKQDDFEAVKWYRKAAEQGDANAQAYLGLAYTEGRGVRQDYTEAVKWFRKAAEQGHANAQAILGFSYLLGKGVQVNKSLAKEWFGKACDNGDQGGCKYYGKLNRGER

SEQ ID NO: 730 - DNA, 264 bp, H. influenzae
taaaatttccaatcaggctttaacgagttaaatggcaaaattggtaagttagacagtaaattagaacgtggtttagcggcggctaacgccctttctggtttagaattgccacaagtggttggaaaagcgagtttttctgctgcggtgggcggttatggcagctgtaatgcgatggcaattggtgtcggctacacactaaaagcaaatatcaagttaaaaagcggtatcaattattcttttcttaaacacctgattttttcctaa

SEQ ID NO: 731 - protein, 86 aa, H. influenzae
NFQSGFNELNGKIGKLDSKLERGLAAANALSGLELPQVVGKASFSAAVGGYGSCNAMAIGVGYTLKANIKLKSGINYSFLKHLIFS

SEQ ID NO: 732 - DNA, 2766 bp, H. influenzae
atgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcaattaacactggtggaagagcagcggaagaagttctaattaatggggcgttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaataa

SEQ ID NO: 733 - protein, 921 aa, H. influenzae
MYKLNVISLIILTTYTGATYASTQGLPQEGLPQEDTVVFGNVTIDKTTADKMTITQSSPTTQINWKSFDIGQNKEVEFKQPSPNAVAYNRVTGGNASQIQGKLTANGKVYLANPNGVIITKGAEINVAGLLATTKDLEQISENGNGNGNSYQFTRKTKDGQELKEGKVLNEGKIKAKDFVVLNGDEVINKEEINVTNGKVYLSSGDNFTFTLLPDSGISVALEDNAVRGIVKNEGIIKAEDITLNAKGRKEALDSLVMNNGVLEATKVSNKNGKVVLSADEIKLDDKSNIKGDMVSFVADVTSNKELKDNIKITSQTGSKVTSPKIDFKGKSVNINGNFGRDDSKAHYNDEHKTLKTEVNIDVPDDENIRIANIEDEDKDSTGSFIQTDALSSLLANNGKVTLKGNNVNISGRIHIDSFRGSDSLLKLTNKGHIKINNADIHSKGRLFFITSLQNEEDFKSNITITDSKINLGNGAMGLGRSVNESDYDNKYQKTEGSQRKKFNVKMSNVEFNQVDDVILAGGFEKVNLDKIVATGQTNFYIDGGVSRNRTNGEPWKYEYGVLDLDKRTQLSELDQGRRRWGYYYDLELDMNRAYLYRFDLFAAKNTRRSTIKGTEINISNSNINLKNGFVHLLAEKIKLDNSKIDITFDKDNSQDTLAQTNRLGMNGKVSMINSHIKIVGDEKSGISPTGTYATMFLIGELIGEKSSIFVKSHQGYTFKTDGDTKIAGKNSKEDLKITAINTGGRAAEEVLINGALGSADNDANIANMAFTIGDSANTKTTIENADITALAPNGGTAYLSSKDVEIEVKPNSDFTFFELPREKNLNQTKINGASTKLSERGFARLYDKINGVRASNLSAEQLNVTDSSEKIINTNLVSSLDVEKLVSVAVCDAGKGCEEQQFGDKGNNTKVSVGELEAEQ

SEQ ID NO: 734 - DNA, 288 bp, H. influenzae
taagttgggcatgttgctaccagcggttacacaaaagatgaatttacaacaaaacttacatttaagactaacaatatgccaataggcggagatgtgaaggcggatcaggaaacatcaggttctagaagcataaaacgcattggctttggttttattggtggtattggctatgacattacaccgaatattaccttagacttagattatcgttataacgattggggacgcttagaaaacgtgcgttttaaaactcacgaagcctctttcggtgtacgttaccgtttttaa

SEQ ID NO: 735 - protein, 94 aa, H. influenzae
VGHVATSGYTKDEFTTKLTFKTNNMPIGGDVKADQETSGSRSIKRIGFGFIGGIGYDITPNITLDLDYRYNDWGRLENVRFKTHEASFGVRYRF

SEQ ID NO: 736 - DNA, 3144 bp, H. influenzae
tagattaaacgtgcttgcctattccgttatgcttgggctaacggcaagtgttgcttatgcagagccaaccaaccaaccaaccaaccaaccaaccaaccaaccaaccaaccaaccaaccaaccaaccaaccaaaatagtaatgcttctgaacaactagaacaaataaatgtatctggctctaccgaaaatactgatacgaaaactccgccaaaaattgccgaaactgtaaaaacggctaaaacgctagaaagagaacaagcaaacaacattaaagacatcgttaaatacgagactggcgttactgttgttgaagctgggcgttttggtcaaagcggttttgcgattagaggggtagatgaaaatcgtgttgcaattacggttgatggcgttgctcaagcagaaacattatcttcccaaggttttaaagacctgtttgaaggatatggtaattttaataacacgcgtaatggaattgaaattgaaactttatctgatgccaaaattaccaaaggtgcagattctctcatgtctggtagtggtgcattgggtggctccgtcatctataaaactaaagatgcaagagatcttctgcttaacaaaaactacgcgtttaaatataaaactggttttaccagcgagaatgatgaaagattaaattctattacttttgcaggaaaagcaagtatattcgatgtacttgctgtcggcacttggcgtaatggtcatgaaatcaaaaattatgattacaaatctgcagacgacattctaggaaaactcagagaaaagaccgatccttataataaaaaagaccgcagtcttttattgaaaattggtacaaatcttggtgaaaataatcgcattgccgtagcctatgatagaagacgggttgaaaataaaggtctagacaaatcttactcattacatggatgcacgaaatatgtttgtgatgataatgaaatagatactcgccatactcatgatgaaagcattagaaccagtaaatctatagcatttgaaaatacaaatataaacccactttgggataccctaaaactctcttatacagatcaaagtattactcaacgagcaagaagtgacgaacattgtgatggtgaacggtgtcctggggtacaaaaccccataggactacattataacaacgataataaacttgttgataaaaataataatcctgtaacctataaattagaaaatcgttctgtaacatactattcttacattgatgaatctatctttaatcgatacagtaactttaaagaagaagttcctgtagaactcgctaaggaatggaaacttaaagaatatggtggaaaatattatattgactcgcctcgctgctttaaaaatcacggtgatgctaatcacgaggggatgtgtagactaagatctgatgtaaaagaggaaaaggaaacattagtagctaataacatcacttatgatttaaaaaaggagtattttattaactcaaggctcacgaatagtgataatttattatcttgtgatggaattaactgtgataaaggtacaattcaaggtttcgaagctgatggaacgcctaaggatttaccaataaaaataatcccaaaagaaggtaaaaaatttgcacttattgaaaaaatttcagatcaaaatggctacaatattggcccagagaaagcatctcgttttctagtacctaattcacctggttataatagaaacatttggaaaaaacgtgaccttgatactcgtactcaacaaattaatttggatttaacaaaacattttgaactaggaaaaagccaacatgatttatcttatggtttagtttggagtaaaacaacaaaatcaatgataaataaagaagggttaaaagttaatagtggaaaatggtggattgattatccaaaagactgtgaatctagtacatcagatttatgtacaaaaaatagtacagcatcatttcttattcctgtagaaacaaaagatggttctctctattttaaagatgaatttagagtaaatgatcgtcttggcttagatatcggttatcgatatgacaaagtcaaatacaaaaccaattatcaaccgggtataacgccaaaaatccctgatgatatgttagttaatttatttataaaagaaccttttgtaaaaaacacacggagtctaaaccctaatgatccaaatgaaattaatcgacgaaaaaatgcagaagctaatattaattatatttctcaacccaaaaaatttaatgcgagttcttatgctttaagcacaaaattcgatccattggattggttacaagttcaagcaaaatatagcaaaggtttcagagcaccaacagctgatgaattatacttcacattcaagcacccagaatttactgttcttccaggctctaaattaaaacctgaaattgcaaaaactaaggaattatcattaactttacatgatgatgaaatcggttttatttctggtggatatttcatcacaaattataataattttattgattttagttatctaggaacaaaatcatttggttctcaagcaactaagcatgaattatatcaatctgttaatttagataatgctaaagtgacaggatttgaattgaaaaccaaatttacattaggaaaatggatatcatggttgaagaatgttgattttggttaccaattaactaaacaaaaaggtaaagcaagcgataaccgcccacttaatgctattcagccaatgacacaagtgatgagtttagcctatacgcatcctgataatctgtttggggcaaatttatatcttactcatgtttcccaaaaagaagcgagtgacacatataacatttattcaaaagatgctacagcaggagataaagaatatgttcaaaataaacatattaaatggcgtagtaaagcttacacagtgacagattttactttcttcgtgaaacctatgaagaatttaactttacgagcgggtgtttacaatttatttgacaaaaaatatatgacttgggattctgctcgttcaattcgtatgtttggtacaagtaatttgattaatcaagaaacaggtgcaggtattaatcgtttctatgctccaggcaaaaactatagaatgtcagttcagtttgaattctaa

SEQ ID NO: 737 - protein, 1046 aa, H. influenzae
IKRACLFRYAWANGKCCLCRANQPTNQPTNQPTNQPTNQPTNQNSNASEQLEQINVSGSTENTDTKTPPKIAETVKTAKTLEREQANNIKDIVKYETGVTVVEAGRFGQSGFAIRGVDENRVAITVDGVAQAETLSSQGFKDLFEGYGNFNNTRNGIEIETLSDAKITKGADSLMSGSGALGGSVIYKTKDARDLLLNKNYAFKYKTGFTSENDERLNSITFAGKASIFDVLAVGTWRNGHEIKNYDYKSADDILGKLREKTDPYNKKDRSLLLKIGTNLGENNRIAVAYDRRRVENKGLDKSYSLHGCTKYVCDDNEIDTRHTHDESIRTSKSIAFENTNINPLWDTLKLSYTDQSITQRARSDEHCDGERCPGVQNPIGLHYNNDNKLVDKNNNPVTYKLENRSVTYYSYIDESIFNRYSNFKEEVPVELAKEWKLKEYGGKYYIDSPRCFKNHGDANHEGMCRLRSDVKEEKETLVANNITYDLKKEYFINSRLTNSDNLLSCDGINCDKGTIQGFEADGTPKDLPIKIIPKEGKKFALIEKISDQNGYNIGPEKASRFLVPNSPGYNRNIWKKRDLDTRTQQINLDLTKHFELGKSQHDLSYGLVWSKTTKSMINKEGLKVNSGKWWIDYPKDCESSTSDLCTKNSTASFLIPVETKDGSLYFKDEFRVNDRLGLDIGYRYDKVKYKTNYQPGITPKIPDDMLVNLFIKEPFVKNTRSLNPNDPNEINRRKNAEANINYISQPKKFNASSYALSTKFDPLDWLQVQAKYSKGFRAPTADELYFTFKHPEFTVLPGSKLKPEIAKTKELSLTLHDDEIGFISGGYFITNYNNFIDFSYLGTKSFGSQATKHELYQSVNLDNAKVTGFELKTKFTLGKWISWLKNVDFGYQLTKQKGKASDNRPLNAIQPMTQVMSLAYTHPDNLFGANLYLTHVSQKEASDTYNIYSKDATAGDKEYVQNKHIKWRSKAYTVTDFTFFVKPMKNLTLRAGVYNLFDKKYMTWDSARSIRMFGTSNLINQETGAGINRFYAPGKNYRMSVQFEF

SEQ ID NO: 738 - DNA, 771 bp, H. influenzae
atgagtaatgtggatgaatctcaacctttaattacgcaccttgttgaactaagaaaccgtttattacgctgtgtgatttgtgtagtgttggtttttgttgctttggtgtatttttccaatgatatttatcattttgttgctgcacctttaacggctgttatgccaaaaggcgcaacaatgattgcaaccaatattcaaactcctttctttacgccaattaaattaactgcgattgttgcaatttttatttctgtcccttatttgctttatcaaatttgggcttttattgcacctgctttatatcagcacgaaaaacggatgatttatccgttgttattttccagtacgattttattttattgcggtgttgcttttgcttactatgtcgtctttcctcttgtattcagcttctttacacaaacagccccagaaggcgttaccatcgcaacagatattagtagttatttagattttgctttagcgttatttttagcttttggcgtttgttttgaagtgccaattgcgattattctactttgctggactggtattaccactgtaaaggctctttccgaaaaacgcccttatattattgttgcagcattttttattggaatgcttttaacgcctcctgatgttttttcacaaactttgcttgccataccgatgtgcttgctgtttgagctcggtctattggtcgctcgattttatcaaccaaaagacgacgaaagtgcggttaaaaataatgatgaatcagaaaaaacacaatga

SEQ ID NO: 739 - protein, 256 aa, H. influenzae
MSNVDESQPLITHLVELRNRLLRCVICVVLVFVALVYFSNDIYHFVAAPLTAVMPKGATMIATNIQTPFFTPIKLTAIVAIFISVPYLLYQIWAFIAPALYQHEKRMIYPLLFSSTILFYCGVAFAYYVVFPLVFSFFTQTAPEGVTIATDISSYLDFALALFLAFGVCFEVPIAIILLCWTGITTVKALSEKRPYIIVAAFFIGMLLTPPDVFSQTLLAIPMCLLFELGLLVARFYQPKDDESAVKNNDESEKTQ

SEQ ID NO: 740 - DNA, 1218 bp, H. influenzae
atgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgctttacgtggttacggtaatttaatcatcatcaaacataatgatgatttcttaagtgcttatgcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgttaa

SEQ ID NO: 741 - protein, 405 aa, H. influenzae
MNKSFLLLPLSLVVLSACTSNSPAPISDADGNLSPSVVQSVNGSNVGGAWQPEIQKNSLPTMGNMVTPQPNFQPINQQPAMPTKPAQPAFQPSPKTVVSAPTVQTKTVTKTIADCVDGQHINIPRNPNTNAPDYSKISKGSYKGNTYKVNKGDTMFLIAYLAGIDVKELAALNNLSEPYNLSLGQVLKISNCGTKTVTTTVSVKQPAVTASTAMPAKPAVTYTPGANGTQIGSDGTIIGPIKSEAGISSSVSVATSSTQVTSSVNNANSTPINANVVAPIASNVAWQWPTSGNIIQGFSSTDGGNKGIDISGSRGQAVKAAAAGRIVYAGNALRGYGNLIIIKHNDDFLSAYAHNDKILVADQQEVKAGQDIAKMGSSGTNTVKLHFEIRYKGKSVDPVRYLPKR

SEQ ID NO: 742 - DNA, 3141 bp, H. influenzae
atgcaagcacagcttatgctgcccaaccaaccaaccaaccaaccaaccaaccaaccaaccaaccaaccaaccaaccaaccaaccaaccaaccaaccaaccaaaatagtaatgtttctgaacaactagaacaaattaatgtttcaggaagtacagaaacaattaatgtgaaagagaaaaaggtaggtgaaacccaaatttctgccaaaaaattagcgaaacagcaggcgtctgattctcgtgatctcgttcgctatgaaacaggtattacggtggttgaaacaggtagaacgggcgcaagtggttatgctgttcgaggggttgatgaaaaccgtgtaggtattatggttgatgggcttcgtcaagctgaaaccttaagctctcaaggatttaaagaattatttgaaggctatggcaattttaataatactcgtaatagcattgaaattgaaaatgttaaaacagcaactattaccaaaggtgctgactccttaaaatccggtagtggtgcattgggtggctctgttatatttgaaactaaagatgctcgagattatctgatagataaagattattatctttcctataaacgtggctatcaaacaatgaataatcaaaaccttaagacacttacattagcaggacgttctaaaaaatttgatattttagtcgttgatacaaaacgtgatgggcacgaaatagaaaactacgattataaaatttatcccaataaacaggcggatttaagtgcggttggtcctacccgtgaaaaagccgatccttatcaaattacccgccaaagcacattaataaaattgggctttcagcctaatgaaaaccatcgcttgagcgtggcattagatgattccactttagaaacaaagggtatggatttgtcttatattttcaatcaatgcaaaaatactaaatgtgaggaaaaatatggcgagcgagttattaatgatcaatctaaaagaaaaaatattcaatttagttatgaaaatttcagtcaaacccctttttgggatcatattaaactaagttattcctcacaaaaaattaccaataaagcacgctctgatgagtattgtcatcaatccacttgtgctggtgtacgtaatccacaagggctacatttagtagaagaaggtggaatttataagattaaagataaagacaatcaagaatttacaggaaaatataattatggcttagaactacaaaacaaaaagggtgaagatgttagtaatgatgtagatacagaaggaggctcacttgattcggtcttaattaattgtgaaaaattaaattgtaataaaaaatttcaggtttttgttggaaaagatgaaaatgggaatgacaaatataattatgaagaccgaaatattaccattaaagaattaaatggcaaaaaatatggtgaaatctcactaaaatcagcagaaggtaattatggattaacccaatatgaaagtgctaaatttttatttccaaaaagccatggctacagcacagacttcgttaatgaccgtgatttaaacacccatacccaacaaattaaacttgatttagacaaagaatttcacctatggcatacccaacaccaactaaaatatggtggactttatgaaaaaacactaaaaagtatggtgaatcatcaatactacactgttgccaatgtgcaatggtgggctggcaattttttctgtaacaaacctgtagatggcacatatcctgtggagcatactcctgcacctgatcatagtgcttacagatgtagcttaatgaattccaataaaggtaaagatacctatttaatccctgttaccactaaaaataatgtgttgtattttggagataatgtgcaacttacctcttggctaggactagatttaaattatcgttatgaccacgtaaaatatttgcctagttatgacaaaaacattcctgttcctaatggattaattactgggctatttaagaaatttagctcaaaggaatatgtttatggtagtaaatactcaatacctccaggatatgaaaattgcacttacgacacaccgtgttataaaaaaaattttgaagacaatcttgccctgttattacgcaaaactgactataaacatcattcttacaatttagggttaaatcttgatcccacaaattggcttcgtgtacagcttaaatacgccaatggttttcgtgcgccaacctctgatgaaatttatatgacatttaaacatccacaattttccattcagcctaacacagatttaaaagctgaaacctccaaaacaaaagaagtcgcgttcactttttataaaaacagtagttatattacgttaaatgcgtttcaaaacgattaccgtaattttattgacttagtagaagtgggcgaacgtcctattgaagaaggctctgcaataaaatatccgttccatcaaaaccaaaatcgagatcgagcaagagtcagaggtatcgaaattgcttcacgtcttgagatgggcgatttatttgaaaaactacaaggtttccatttaggctataaatttacctatcaaaaaggcagaatcaaagacaatggattacatccaaaatataaagaatttttggaattgaataaagatgaacatccagaatacgaagccattgctcgtaaacctcaaccaatgaatgccttacaaccaaccacatcggtatacaatattggctatgatgcaccaagccaaaaatggggcgtggatatgtatatcactaatgttgcagcaaaaaaagcaaaagatagctttaattctcaatggacaagtatggtcgccagaaaagaaaagcaatatactgacaatgcaacagatatacctgctacaaaagcaaacggcaaagatgtaaaagattctcgcggattatggcgtaataatcgctatacagtgatcgatacgattgcctattggaaaccaattaaaaatcttacatttaccgctggtgtatataatttaaccaacaaaaaatatctcacttgggactctgctcgctctgttcgacatcttggcacaattaaccgagtaaaaacagaaactggtgaaggcttaaaccgcttttatgcacctggcagaaattacagaatgtctgttcagtttgaattttaa

SEQ ID NO: 743 - protein, 1046 aa, H. influenzae
MQAQLMLPNQPTNQPTNQPTNQPTNQPTNQPTNQNSNVSEQLEQINVSGSTETINVKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILVVDTKRDGHEIENYDYKIYPNKQADLSAVGPTREKADPYQITRQSTLIKLGFQPNENHRLSVALDDSTLETKGMDLSYIFNQCKNTKCEEKYGERVINDQSKRKNIQFSYENFSQTPFWDHIKLSYSSQKITNKARSDEYCHQSTCAGVRNPQGLHLVEEGGIYKIKDKDNQEFTGKYNYGLELQNKKGEDVSNDVDTEGGSLDSVLINCEKLNCNKKFQVFVGKDENGNDKYNYEDRNITIKELNGKKYGEISLKSAEGNYGLTQYESAKFLFPKSHGYSTDFVNDRDLNTHTQQIKLDLDKEFHLWHTQHQLKYGGLYEKTLKSMVNHQYYTVANVQWWAGNFFCNKPVDGTYPVEHTPAPDHSAYRCSLMNSNKGKDTYLIPVTTKNNVLYFGDNVQLTSWLGLDLNYRYDHVKYLPSYDKNIPVPNGLITGLFKKFSSKEYVYGSKYSIPPGYENCTYDTPCYKKNFEDNLALLLRKTDYKHHSYNLGLNLDPTNWLRVQLKYANGFRAPTSDEIYMTFKHPQFSIQPNTDLKAETSKTKEVAFTFYKNSSYITLNAFQNDYRNFIDLVEVGERPIEEGSAIKYPFHQNQNRDRARVRGIEIASRLEMGDLFEKLQGFHLGYKFTYQKGRIKDNGLHPKYKEFLELNKDEHPEYEAIARKPQPMNALQPTTSVYNIGYDAPSQKWGVDMYITNVAAKKAKDSFNSQWTSMVARKEKQYTDNATDIPATKANGKDVKDSRGLWRNNRYTVIDTIAYWKPIKNLTFTAGVYNLTNKKYLTWDSARSVRHLGTINRVKTETGEGLNRFYAPGRNYRMSVQFEF

SEQ ID NO: 744 - DNA, 291 bp, H. influenzae
atggctacgataactaaacttgatattattgaatatttaagcgataaatatcacttatctaaacaagatacgaaaaatgtggtggagaactttttggaagagatccgcttatcgctagaatctggtcaagatgtgaaattatcaggatttggtaattttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatag

SEQ ID NO: 745 - protein, 96 aa, H. influenzae
MATITKLDIIEYLSDKYHLSKQDTKNVVENFLEEIRLSLESGQDVKLSGFGNFELRDKSSRPGRNPKTGDVVPVSARRVVTFKPGQKLRARVEKTK

SEQ ID NO: 746 - DNA, 2739 bp, H. influenzae
atgactaaaaaaccctattttcgcctaagtattatttcttgtcttttaatttcatgctatgtaaaagcagaaactcaaagtataaaagatacaaaagaagctatatcatctgaagtggacactcaaagtacagaagattcagaattagaaactatctcagtcactgcagaaaaagtaagagatcgtaaagataatgaagtaactggacttggcaaaattatcaaaactagtgaaagtatcagccgagaacaagtattaaatattcgtgatctaacacgctatgatccagggatttcagttgtagaacaaggtcgcggtgcaagttctggatattctattcgtggtatggacagaaatagagttgctttattagtagatggtttacctcaaacgcaatcttatgtagtgcaaagccctttagttgctcgttcaggatattctggcactggtgcaattaatgaaattgaatatgaaaatgtaaaggccgtcgaaataagcaagggggggagttcttctgagtatggtaatggagcactagctggttctgtaacatttcaaagcaaatccgcagccgatatcttagaaggagacaaatcatggggaattcaaactaaaaatgcttattcaagcaaaaataaaggctttacccattctttagctgtagcaggaaaacaaggtggatttgaaggacttgctatttacactcaacgaaattcaattgaaacccaagtccataaagatgcattaaaaggcgtgcaaagttataatcgattaatcgccaaagaagatggatctaatgcatactttgtgatggaagatgagtgtccaaaggattataacagttgtataccttcagccaaaccacctgcgaagttatcctcccaaagagaaaccgtaagcgtttcagattatacgggggctaaccgtatcaaacctaatccaatgaaatatgaaagccagtcttggtttttaagaggaggctatcatttttctgaacaacattatattggtggtatttttgaattcacacaacaaaaatttgatatccgtgatatgacatttcccgcttatttaagatcaacagaaaaaccggatttagaaaatagttctttttatccaaagcaagattatggtgcatatcaacgtattgaggatggccgaggcgttaaatatgcaagtgggctttatttcgatgaacaccatagaaaacagcgtgtaggtattgaatatatttacgaaaataagaacaaagcgggaatcattgacaaagcagtgttaagtgctaatcaacaaaacattatacttgacagttatatgcaacatacacattgcagtctttatcctaatccaagtaagaattgccgcccaacacttgataaaccttattcatactatcattctgatagaaatgtttataaagaaaaacataatatgttgcaattgaatttagagaaaaaaattcaacaaaattggcttactcatcaaattgtcttcaatcttggttttgatgactttacttcagcgcttcagcataaagattatttaactcgacgtgttaccgctacggcaaagagtatttcagagaaacctggtgaaacaccaagaagaaatggtttcaaattacaaccttacttatacccaaaaccaaatgcatcttttgtaggacgagatcattgtaattatcaaggtagctcctctaattatagtgactgtaaagtgcggttaattaaagggaaaaattattatttcgcagcacgcaataatatggcattagggaaatacgttgatttaggtttaggtattcggtatgacgtatctcgtacaaaagctaatgaatcaactattagtgttggtaaatttaaaaatttctcttggaatactggtattgtcataaaaccaacggaatggcttgatctttcttatcgcctttctactggatttagaaatcctagttttgctgaaatgtatggatggcggtatggtggcaagaatgacgaggtttatgtaggtaaatttaagcctgaaacatctcgtaaccaagagtttggtctcgctctaaaaggggattttggtaatattgagatcagtcattttagtaatgcttatcgaaatcttatcgcctttgctgaagaacttaaaaatggaaagggcaagggcaattatggatatcataatgcacaaaatgcaaaattagttggcgtaaatataactgcgcaattagattttaatggtttatggaaacgtattccctacggttggtatgcaacatttgcttataaccgagtaaaagttaaagatcaaaaaatcaatgctggtttagcctccgtaagcagttatttatttgatgccattcagcccagccgttatatcattggtttaggctatgatcatccaagtaatacttggggaattaatacaatgtttactcaatcaaaagcaaaatctcaaaatgaattgctaggacaacgttcattaggtaacacttcaaggggtgtaaaatcaacaagaaaacttactcgggcatggcatatcttagatgtatcgggttattacatggtgaatagaagtattttgttccgattaggagtatataatttattaaactatcgctatgtcacttgggaagcggtgcgtcaaacagcacaaggagcggtcaatcaacatcaaaatgttggtaattatactcgctacgcagcatcaggacgaaactataccttaacattagaaatgaaattctaa

SEQ ID NO: 747 - protein, 912 aa, H. influenzae
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYNRLIAKEDGSNAYFVMEDECPKDYNSCIPSAKPPAKLSSQRETVSVSDYTGANRIKPNPMKYESQSWFLRGGYHFSEQHYIGGIFEFTQQKFDIRDMTFPAYLRSTEKPDLENSSFYPKQDYGAYQRIEDGRGVKYASGLYFDEHHRKQRVGIEYIYENKNKAGIIDKAVLSANQQNIILDSYMQHTHCSLYPNPSKNCRPTLDKPYSYYHSDRNVYKEKHNMLQLNLEKKIQQNWLTHQIVFNLGFDDFTSALQHKDYLTRRVTATAKSISEKPGETPRRNGFKLQPYLYPKPNASFVGRDHCNYQGSSSNYSDCKVRLIKGKNYYFAARNNMALGKYVDLGLGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELKNGKGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRSLGNTSRGVKSTRKLTRAWHILDVSGYYMVNRSILFRLGVYNLLNYRYVTWEAVRQTAQGAVNQHQNVGNYTRYAASGRNYTLTLEMKF

SEQ ID NO: 748 - DNA, 888 bp, H. influenzae
atgcaagataaagaacctgatgaattccgcgaaagcacctcaatctttcaaatttggttacgctttcgtcaaaataccatcgcactttttagcttttatttattaatcgcattaatttttaccgcactttttgctagttatcttgcaccttatgctgataatcgacaatttattgggcaagaattaatgcctccttcttgggtagatagaggaaaaattgcttttttctttggtactgatgatttaggtcgcgacatattaagtcgtttaattatgggtactcgttataccttaggttctgctttactggttgtcttttcagtggcaataataggcggcgcactaggaattattgcaggactactgaaaggtattaaagctcgttttgtcgggcatatttttgatgcttttttatcgttacctattctattaattgccgttgttatttcaacattaatggaaccaagtttatggaatgcaatgtttgctacgctattagcaattttgccttatttcattcacactatctatcgcgctattcaaaaagaattagaaaaggattatgttgtaatgctaaaacttgaaggcatttccaatcaaaccttattaaaaagcactattttaccgaatattactgttatttatattcaagaagtggctcatgcttttgttatagccgtgttggatattagcgcattaagttttatttctcttggtgcacaacgacctacaccagaatggggggcaatgataaaagactctttggaactactttatcttgcaccttggacagtacttttacccggtttcgctattatttttactattttattaagtattattttcagtaatggcttaactaaagccatcaatcaacatcaagaatag

SEQ ID NO: 749 - protein, 295 aa, H. influenzae
MQDKEPDEFRESTSIFQIWLRFRQNTIALFSFYLLIALIFTALFASYLAPYADNRQFIGQELMPPSWVDRGKIAFFFGTDDLGRDILSRLIMGTRYTLGSALLVVFSVAIIGGALGIIAGLLKGIKARFVGHIFDAFLSLPILLIAVVISTLMEPSLWNAMFATLLAILPYFIHTIYRAIQKELEKDYVVMLKLEGISNQTLLKSTILPNITVIYIQEVAHAFVIAVLDISALSFISLGAQRPTPEWGAMIKDSLELLYLAPWTVLLPGFAIIFTILLSIIFSNGLTKAINQHQE

SEQ ID NO: 750 - DNA, 852 bp, H. influenzae
atgatgcgaattcttcttttcttggcaaccaatatggctgtaatgctggtattggggattattttaaatgtgactggtattgcaggaaatagcactggcggcattttaattatggctttgctatttggttttgctggttcattaatttccttattcctgtctaaaacgatggcattacgttctgtagatggagaagtgattactcaacctcgtaatcaaactgaacgttggttaattgatactgttagtcgccaagcacagaaagcgggaattccgatgccagacgtggcgatttatcattcacccgatgtgaatgcttttgctacaggtgcaacgaaaagcaattctttagtggcagtgagtacgggattattaaacaacatgacggaggctgaagctgaagctgttttagcgcacgaaatttctcatatttccaatggcgatatggtgacgatggcgttattgcaaggcgtattgaatactttcgtgattttcttatctcgcgttatcgcaacggcggtagcaagttcgcgtaacaataatggagaggaaacgcgcagttcaggtatttatttcttggtttctatggtattggaaatgctctttggtgtgcttgcgagtattatcgcaatgtggttctctcgttaccgagaatttcgtgcagatgctggttccgcaagtttagtaggcaaagaaaaaatgattatggcactgcaacgtttgcaacaacttcacgaaccacaaaatctcgaaggttctttaaatgcctttatgattaatggtaaacgcagtgaactctttatgagccatccaccactcgaaaagcgtattgaagccttacgtaatctttaa

SEQ ID NO: 751 - protein, 283 aa, H. influenzae
MMRILLFLATNMAVMLVLGIILNVTGIAGNSTGGILIMALLFGFAGSLISLFLSKTMALRSVDGEVITQPRNQTERWLIDTVSRQAQKAGIPMPDVAIYHSPDVNAFATGATKSNSLVAVSTGLLNNMTEAEAEAVLAHEISHISNGDMVTMALLQGVLNTFVIFLSRVIATAVASSRNNNGEETRSSGIYFLVSMVLEMLFGVLASIIAMWFSRYREFRADAGSASLVGKEKMIMALQRLQQLHEPQNLEGSLNAFMINGKRSELFMSHPPLEKRIEALRNL

SEQ ID NO: 752 - DNA, 2766 bp, H. influenzae; identical to SEQ ID NO: 732

SEQ ID NO: 753 - protein, 921 aa, H. influenzae; identical to SEQ ID NO: 733

SEQ ID NO: 754 - DNA, 1698 bp, H. influenzae
atgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttctaa

SEQ ID NO: 755 - protein, 565 aa, H. influenzae
MKMRPRYSVIASAVSLGFVLSKSVMALGQPDTGSLNRELEQRRIQPEAKPSGELFNQAAKSPYTAQYKQELKFPLTQVQILDRNNQEVVTDELAHILKNYVGKEVSLSDLSNLANEISEFYRNNNYLVAKAILPPQEIEQGTVKILLLKGNVGEIRLQNHSALSNKFVSRLSNTTVNTSEFILKDELEKFALTINDVPGVNAGLQLSAGKKVGEANLLIKINDAKRFSSYVSVDNQGNKYTGRYRLAAGTKVNNLTGWGDELKLDLLSSNQANLKNARIDYSSLIDGYSTRFGVTANYLHYKLGGNFKSLQSQGHSHNLGAYLLHPTIRTPNFRLSTKVSFNHQNLTDEQQAVTVKQKRKINSLTVGIDGSWNLIKDGTTYFSLSTLFGNLANQTNEKKHNAKEDFQPQSHFTVYNYRLSHEQILPKSFAFNIGINGQFADKTLESSQKMLLGGLSGVRGHQAGAASVDEGHLIQTEFKHYLPVFSQSVLVSSLFYDYGFGKYYKNSQSLAQSVKNSVKLQSVGAGLSFSDAGSYAINVSVAKPLDNNIDNADKHQFWLSMIKTF

SEQ ID NO: 756 - DNA, 2130 bp, H. influenzae
atgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaaacagcgaaaaataaagaaattaccgcaaatctacattttgatagcctgtttaaacaaggcgataaattcaaaattgaagcgacttatttccgcaatgatgtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttctaa

SEQ ID NO: 757 - protein, 709 aa, H. influenzae
MRFSKLSLAITTTLVTANALAQSVELDSINVIATRDPSRFTYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRIGKGNKLNNTAYKQFGGLAKFGWQINDANRVELSHRETRFKQTAPGNNEAKNELTNEQIIEKINEYHNPLNNFPPKAKPSLEEFYSGVRARLGGVSYLSDQQIPDQSTVFNYYLTPDNPYLNTHIALYNNKTIEKEQRKVSGVKDQTKLTTRGINLRNSSELSHISFVYGVDYMRDKISTERGTNDKDAKFRAEPYNANSNTTGVYLIAHIPLFGEKLLLSPSVRYDHYDTSSKTVKYKDNHLSPATKLTWKVTNWLDFTAKYNEAFRAPSMQERFVSGAHFGTSTRVGDIINSFVANPNLRPETAKNKEITANLHFDSLFKQGDKFKIEATYFRNDVKDLINLKRLDDPNANGALSRTNSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 758 - DNA, 1536 bp, H. influenzae
taaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaataa

SEQ ID NO: 759 - protein, 510 aa, H. influenzae
KDLTLPRRPPFWLTLLIILIGLPLCLPFLYVILRATEVGLTRSVELLFRPRMAELLSNTMLLMVCVTIGAISLGTLCAFLLERYRFFGKAFFEVAMTLPLCIPAFVSCFTWISLTFRVEGFWGTIGIMTLSSFPLAYLPVSAILKRLDRSLEEVSLSLGKSPVYTFWYVIFPQLKPAIGSSILLIALHMLIEFGAVSILNYQTFTTAIFQEYEMSFNNSTAALLSAVLMAICILIVFGEIFFRGKQTLYHSGKGVTRPYLVKTLSFGKQCLTFGFFSSIFILSIGVPVIMLIYWLIVGTSLESAGDFSEFLSAFSNSFIISGLGALLTVMCALPLVWAAVRYRSYLTIWIDRLPYLLHAVPGLVIALSLVYFSIHYANDLYQTFFVIIIAYFMLYLPMAQTTLRASLEQLSDQIEKVGQSLGRSPFYIFRTLTLPAILPGVAAAFALVFLNLMKELTATLLLTSNDIKTLSIAVWEHTSDAQYAAATPYALMLVLFSGIPVFLLKKYAFK

SEQ ID NO: 760 - DNA, 2472 bp, H. influenzae
atgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaa

SEQ ID NO: 761 - protein, 823 aa, H. infleunzae
MRHFDVQLIGGMVLTNRCIAEMRTGEGKTLTATLPCYLIALEGKGVHVVTVNDYLARRDAETNRPLFEFLGMSVGVNIPGLSPEEKRAAYAADITYATNSELGFDYLRDNLAHSKEERFQRTLGYALVDEVDSILIDEARTPLIISGQAENSSELYIAVNKLIPSLIKQEKEDTEEYQGEGDFTLDLKSKQAHLTERGQEKVEDWLITQGLMPEGDSLYSPSRIVLLHHVMAALRAHTLFEKDVDYIVKDGEIVIVDEHTGRTMAGRRWSDGLHQAIEAKEGVDVKSENQTVASISYQNYFRLYERLAGMTGTADTEAFEFQQIYGLETVVIPTNRPMIRDDRTDVMFENEQYKFNAIIEDIKDCVERQQPVLVGTISVEKSEELSKALDKAGIKHNVLNAKFHQQEAEIVAEAGFPSAVTIATNMAGRGTDIILGGNWKAQAAKLENPTQEQIEALKAEWEKNHEIVMKAGGLHIIGTERHESRRIDNQLRGRSGRQGDPGSSRFYLSLEDGLMRIYLNEGKLNLMRKAFTVAGEAMESKMLAKVIASAQAKVEAFHFDGRKNLLEYDDVANDQRHAIYEQRNHLLDNDDISETINAIRHDVFNGVIDQYIPPQSLEEQWDIKGLEERLSQEFGMELPISNWLEEDNNLHEESLCERIVEIAEKEYKEKEALVGEDAMRHFEKGVMLQTLDELWKEHLASMDYLRQGIHLRGYAQKDPKQEYKKESFRMFTEMLDSLKHQVITTLTRVRVRTQEEMEEAERARQEMAARINQNNLPVDENSQTTQNSETEDYSDRRIGRNEPCPCGSGKKYKHCHGSRVARQ

SEQ ID NO: 762 - DNA, 5385 bp, H. influenzae
atgctaaataaaaaattcaaactcaattttattgcgcttactgtcgcctacgcattaaccccttatacagaagccgcgttagtgagaaacgatgtggattatcaaatatttcgtgattttgcagagaataaagggaagttttctgttggtgcaacaaatgtggaagtgagagataacaaaaataataatttgggcagtgcgctacctaaagatattccgatgattgattttagtgctgtggatgtagataagagaattgccacgttggtaaatccacaatatgttgtgggggtaaaacacgttggtaacggtgtgggtgaactacattttgggaatttaaatgggaattggaaccctaaatttggaaattctattcagcatcgagatgtatcttgggaggaaaacagatattacactgttgaaaaaaataatttttcttctgaattaaacggaaaaacacaaaataacgaaaaagataaacagtatacatctaataaaaaagatgttccttccgaattatatggacaagccttagttaaagaacagcaaaaccaaaaacgccgtgaagattattatatgccacgccttgataaatttgttaccgaagttgcaccgatagaggcttcaactacaagtagtgatgctggaacatataatgatcagaataaatatcctgcttttgtgagattaggaagtggctctcaatttatctataaaaaaggaagccattatgaattaattttagaagagaaaaacgagaaaaaggaaataatacacagatgggatgtaggtggagataatcttaaattagttggtaacgcttatacctatggtattgcaggcacgccttataaagtgaatcatacagacgatggactcattgggtttggtgattcaaccgaagatcataacgatccaaaagagatattatctcgtaaaccgcttactaattatgctgtcttgggagatagtggctcaccgttatttgtttatgataaatctaaagagaaatggcttttccttggtgcttatgatttttggggagggtataagaaaaaatcttggcaagaatggaatatttataaaccacaatttgctgaaaatattctcaaaaaagacagtgctggtttactgaaaggtaatacgcaatataactggacaagcaaaggtaatacaagcttgatatctggaacatctgaatcattaagtgttgatttagtggataataaaaatctcaatcatgggaaaaatgttacgtttgaaggaagtggaaaccttaccttaaataataatatcgatcaaggtgcaggcggattgttctttgaaggtgattatgaagttaaaggcacttcagaaaatacgacttggaaaggggctggtatatctgttgctgaaggaaaaacagtaaagtggaaagtgcataaccctcaatttgatcgtttagctaaaattggtaaaggaaagctaattgttgaaggaagaggagataataaaggttcgctaaaagtgggcgatggcacagttgttttaaaacaacaaacaactacaggacaacacgcttttgcttctgtaggaattgtaagtggtcgctcaactgttgtacttaatgatgataaccaagtagatccaaattcaatttactttggttttagaggcggtcgattagatgccaatggcaataatctcacttttgaacatatccgtaatattgatgatggtgcaagactagttaatcataatatgactaatgcctcaaatataacgattactggagcaggattaattacaaatccaagtcaggtcactatatatacaccagcaataaccgccgatgatgataattattactatgtgccatctattccaagaggaaaagatctttactttagtaatacctgttataaatactatgcgttaaagcaaggtggaagccctactgcagaaatgccttgctatagctctgaaaaatcagatgctaattgggaattcatgggcgacaatcaaaatgatgcacaaaagaaagccatggtgtacatcaataacagacgtatgaatggctttaatggttattttggcgaggaagcaactaaggcagatcaaaacggtaaattaaatgttacctttagtggcaaaagtgatcaaaatcgctttttattgactggcggaacaaaccttaacggtgaattaaaagttgaaaaaggtacattattcctttctggcagaccaacaccacacgcaagagatattgcaaatatttcttcaacagaaaaagataaacactttgctgaaaataatgaagtggtggtagaagacgactggattaaccgcacttttaaagcaacaaatattaatgtaaccaataacgcaaccctttattcaggtcgcaatgttgaaagtattacttcaaatatcacagcctctaataaagcaaaagtgcatatcggctataaagcaggcgataccgtttgtgtacgttctgactatacgggctatgtgacttgccataatgacactttatctacaaaagcactcaatagttttaatccaactaatttgcgcggtaatgtaaatttaaccgaaagtgcaaactttaccttaggcaaagctaacttatttggcacaattaacagcacggaaaatagccaagttaatttaaaagaaaacagccattggtatttaacaggaaatagtgatgttcatcaattagatctagcaaatgggcatattcatttaaataatgtctcagatgcaacaaaagaaacaaaataccacacgctcaatattagcaatttatcaggtaatggttctttctattattgggttgattttaccaaaaatcagggcgacaaagttgttgtaaccaaatcagccaaaggtacctttacattacaagtggcaaataaaacaggcgagccaaatcataatgaacttacgctttttgatgcgtcaaatgcaactgaaagaagtggcttaaatgtttcactggctaatggcaaagttgatcgaggtgcttggagctatactttgaaagaaaatagtggacgttattacttgcataacccagaagtagaaagaagaaatcaaactgtcgatacgccaagtattgcaacagctaataatatgcaagctgatgtacctagcgtatcaaataaccatgaagaaaccgctcgtgttgaagcaccaattccactgccagcaccacctgcacctgctactggatcagcaatggcaaacgagcaaccagaaactcgtcctgcagaaaccgttcaacctacaatggaagatacaaatactactcacccatcgggatctgaaccacaagctgatacaacacaggctgatgatccaaattcagaaagtgttccatcagagacaattgaaaaagtggctgaaaatagtccgcaagaaagtgaaacagtagcgaaaaacgagcaaaaagcaaccgagacaacagctcaaaatgatgaagttgcaaaagaagctaaaccaactgtggaagctaacactcaaacaaatgaactcgcccaaaatggaagcgaaaccgaggaaactcaagaggctgaaactgctcgtcagtctgaaataaattctactgaagaaacagtagtagaagatgatcctacaatcagtgaaccaaagagcagacctagaagaagtattagctcgtcttctaataatataaatctagcaggaacagaagatactgctaaagtagaaacagagaaaactcaagaagcccctcaagtggcttttcaagcgtctccaaaacaagaagaaccagaaatggctaaacagcaagaacagcctaaaactgttcaatcgcaagcacagccagaaactaccacacagcaagcagagcctgctcgtgaaaatgtttcgactgttaataatgtaaaagaagctcaaccgcaagcaaaacctacaactgttgctgcgaaagagacaactgcatcaaacagtgaacagaaagaaactgctcaacctgtagctaatccaaaaacagctgaaaataaagcagaaaatcctcaatcaacagaaacgacagatgaaaatattcatcagcctgaagcccacactgctgttgcttcaacagaagttgttacacctgaaaatgctacaacacctattaaacctgttgagaataaaactacagaagctgaacaacctgtgacagaaaccacaacagtaagcactgaaaaccctgtagtgaaaaatccagagaatacaacacctgctacaactcaatctacggttaattcagaggcagttcaatcagaaacagcgacaacagaagctgttgttagccagtctaaagtgacttctgctgaagaaacaacagtagcttctactcaagaaacaacagtggataattcaggatctactccacaaccacgaagcagaagaactcgtagatcagctcagaatagttacgagccagtggaactacatactgaaaatgcggagaatccgcaatcgggaaatgatgtggctacacaactagtattgcgcgatctcacaagtacaaacaccaatgcggtaatttctgatgccatggcaaaagcacaatttgttgcattaaatgtagggaaagccgtttctcaacatattagccagttagaaatgaataacgaggggcaatataacgtttgggtatctaatacttcaatgaaagaaaattattcctcaagtcaatatcgtcattttagttctaaaagtgcgcaaactcaacttggttgggatcaaacaatctcaagcaatgttcagttaggtggtgtgtttacttatgttcgcaatagtaacaactttgataaggcaagcagtaaaaataccttagcacaagcaaatctctattctaaatattatatggataatcattggtatttagcggtggatttaggctatggtaatttccaaagcaacttacaaactaatcataatgcgaaatttgctcgccatactgcacaatttggtttaaccgcaggcaaagcatttaatcttggcaattttgctgttaaaccaactgtaggggttcgttatagttacttatcaaacgctaattttgcattagctaaagatcgcattaaagtaaatccaatatctgtcaaaacagcctttgctcaagttgatttaagttatacttatcacttaggcgagttttccattacgccaattttgtctgctcgatatgatgcaaatcaaggcagcggcaaaattaatgtagatagatatgattttgcttacaatgtggaaaaccaacagcaatataacgcaggacttaaattgaaatatcataatgtgaaattaagtctaattggcggattaacaaaagcaaaacaagcggaaaaacaaaaaactgcagaagtgaaactaagttttagtttttaa

SEQ ID NO: 763 - protein, 1794 aa, H. influenzae
MLNKKFKLNFIALTVAYALTPYTEAALVRNDVDYQIFRDFAENKGKFSVGATNVEVRDNKNNNLGSALPKDIPMIDFSAVDVDKRIATLVNPQYVVGVKHVGNGVGELHFGNLNGNWNPKFGNSIQHRDVSWEENRYYTVEKNNFSSELNGKTQNNEKDKQYTSNKKDVPSELYGQALVKEQQNQKRREDYYMPRLDKFVTEVAPIEASTTSSDAGTYNDQNKYPAFVRLGSGSQFIYKKGSHYELILEEKNEKKEIIHRWDVGGDNLKLVGNAYTYGIAGTPYKVNHTDDGLIGFGDSTEDHNDPKEILSRKPLTNYAVLGDSGSPLFVYDKSKEKWLFLGAYDFWGGYKKKSWQEWNIYKPQFAENILKKDSAGLLKGNTQYNWTSKGNTSLISGTSESLSVDLVDNKNLNHGKNVTFEGSGNLTLNNNIDQGAGGLFFEGDYEVKGTSENTTWKGAGISVAEGKTVKWKVHNPQFDRLAKIGKGKLIVEGRGDNKGSLKVGDGTVVLKQQTTTGQHAFASVGIVSGRSTVVLNDDNQVDPNSIYFGFRGGRLDANGNNLTFEHIRNIDDGARLVNHNMTNASNITITGAGLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRTFKATNINVTNNATLYSGRNVESITSNITASNKAKVHIGYKAGDTVCVRSDYTGYVTCHNDTLSTKALNSFNPTNLRGNVNLTESANFTLGKANLFGTINSTENSQVNLKENSHWYLTGNSDVHQLDLANGHIHLNNVSDATKETKYHTLNISNLSGNGSFYYWVDFTKNQGDKVVVTKSAKGTFTLQVANKTGEPNHNELTLFDASNATERSGLNVSLANGKVDRGAWSYTLKENSGRYYLHNPEVERRNQTVDTPSIATANNMQADVPSVSNNHEETARVEAPIPLPAPPAPATGSAMANEQPETRPAETVQPTMEDTNTTHPSGSEPQADTTQADDPNSESVPSETIEKVAENSPQESETVAKNEQKATETTAQNDEVAKEAKPTVEANTQTNELAQNGSETEETQEAETARQSEINSTEETVVEDDPTISEPKSRPRRSISSSSNNINLAGTEDTAKVETEKTQEAPQVAFQASPKQEEPEMAKQQEQPKTVQSQAQPETTTQQAEPARENVSTVNNVKEAQPQAKPTTVAAKETTASNSEQKETAQPVANPKTAENKAENPQSTETTDENIHQPEAHTAVASTEVVTPENATTPIKPVENKTTEAEQPVTETTTVSTENPVVKNPENTTPATTQSTVNSEAVQSETATTEAVVSQSKVTSAEETTVASTQETTVDNSGSTPQPRSRRTRRSAQNSYEPVELHTENAENPQSGNDVATQLVLRDLTSTNTNAVISDAMAKAQFVALNVGKAVSQHISQLEMNNEGQYNVWVSNTSMKENYSSSQYRHFSSKSAQTQLGWDQTISSNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALAKDRIKVNPISVKTAFAQVDLSYTYHLGEFSITPILSARYDANQGSGKINVDRYDFAYNVENQQQYNAGLKLKYHNVKLSLIGGLTKAKQAEKQKTAEVKLSFSF

SEQ ID NO: 764 - DNA, 1533 bp, H. influenzae
atggacaattccgcaaaaaaattcccgcctattcaaggtggtgtgctgattttattaacactggctttatctctcgccacctttatgcaggtattagattctaccattgcaaatgtggcgattcctactattgcgggcgatcttggcgcatcttttagtcaaggtacgtgggtaatcacttcttttggggtagcaaatgcgatttctattccaataacgggttggttagcaaaacgttttggcgaagtgcggttatttttagtctcaacttttttatttgttgtctcttcttggctctgtgggattgcagatagtcttgaggcgttaattatttttcgcgtcattcaaggtgctgtcgcaggtccagtgatccctctttcgcaaagtttattattaaataattatccaccagaaaaacgcggaatggcattggcattttggtcaatgactattgtggttgcgcctatttttggcccaattttaggcggatggattagcgataatatccattggggatggatcttttttatcaatgttccgatcggtttgttagttgtgctaatcagctggaagattttgggaagcagagaaagtgaaattgttcatcaacctattgataaagtcggtttagttttacttgtcttaggagtgggatgtttgcaattaatgcttgatcagggtcgtgagcaagattggtttaattctaatgaaatcattatattagccgttgttgctgtcgtttgtctgattgccttggttatttgggaattgacagatgacaatcctgtagtggatatttcacttttccattctcgtaattttagcgtagggtgtttatgtactagtttagcctttttgatttatctaggttctgtggtattaattccgctcttgctacaacaagtcttccattacaccgcgacgtgggcagggcttgcggcttccccagttggattattcccaattttgctttcaccgattattgggcgtttcggttataagatcgatatgcgaattttagtgacgataagctttattgtatatgcaataacattttattggcgagcggtaactttcgagccatcaatgacatttgttgatgtagctttaccacaattagtgcaaggtttagcggtgtcctgtttctttatgccacttactacaataacgctgtctggcttgcctgcgcataaaatggcttcagcctctagcttatttaactttttgagaactttagcgggttctgtaggaacatctttgaccacatttatgtggtataaccgtgaagctgttcaccacactcaattaacagaacacattaatccttataacccgatttcccaaagtttttaccatcaaatgaatcaatttggtttaagtgatacgcaaacttcagcttacctcgctcaacaaataacatcgcaaggatttattattggcgcaaatgaaatattttggttatcagctatgggattcttaggattgcttattgtgatttggtttgcaaaaccaccttttagtactcagcattaa

SEQ ID NO: 765 - protein, 510 aa, H. influenzae
MDNSAKKFPPIQGGVLILLTLALSLATFMQVLDSTIANVAIPTIAGDLGASFSQGTWVITSFGVANAISIPITGWLAKRFGEVRLFLVSTFLFVVSSWLCGIADSLEALIIFRVIQGAVAGPVIPLSQSLLLNNYPPEKRGMALAFWSMTIVVAPIFGPILGGWISDNIHWGWIFFINVPIGLLVVLISWKILGSRESEIVHQPIDKVGLVLLVLGVGCLQLMLDQGREQDWFNSNEIIILAVVAVVCLIALVIWELTDDNPVVDISLFHSRNFSVGCLCTSLAFLIYLGSVVLIPLLLQQVFHYTATWAGLAASPVGLFPILLSPIIGRFGYKIDMRILVTISFIVYAITFYWRAVTFEPSMTFVDVALPQLVQGLAVSCFFMPLTTITLSGLPAHKMASASSLFNFLRTLAGSVGTSLTTFMWYNREAVHHTQLTEHINPYNPISQSFYHQMNQFGLSDTQTSAYLAQQITSQGFIIGANEIFWLSAMGFLGLLIVIWFAKPPFSTQH

SEQ ID NO: 766 - DNA, 1467 bp, H. influenzae
tgaaagttatttgtctgtctgtttgtctgtttgtttgttttttcaaaatatagaattacaagaatattagttggcgctttatttgcaataagtattgttgttaataatgtacattatgcagtataccaatcttggattggacctgttaattactcacttgcatttaaagaaattaatgagataacaaatgctggcttaacaatgatagataaattcatatatccattgttatttggtttatttgaagttgctgtgtttttaagtttaagtttcataaaaagaaaagtatataaactttcttggatttttgactttattttttatgctgtgatgatgtatgtttttgttcgagcgtatacaacaaaatcccatgagcgttttatttcacctaacactgtttattctcgattaaaatccaattatttatcgttgggttattttataggacgaattgttccttatgagatattttctttatctaatattcctctttatcataaatctaagcctatgaaatcgggctctccgaaaattaagaatataattttaattatgggggaaagtgcgacctcaagtcattttagtgcttttggttacgggagaaaaacatctccttttttagatagcttaaaatataaatcaggagctcttgttggtaaaacttattcaggaggaaagctaacagcaatttctttaccaatgttttttaatgcaattccttatccaaatggaatacaacagatagctaaaggagatacgaatttatttaatttagcgaaagagcaaggctttcagacatatttttattcagctcaagctagggatgatatgcatatgatcaattttttaggaggagcttggattgatgatattcgttttccagataatgaagggtattctttaagagattcaatgcctgataataaattacttcctgcttttaaaaatattaatttagataatggttatcattttgttgttttacatcatagagggagtcatattccctatggggcattattagatgaaaaagagaaggtgtttggaaaaaataacgcaacagataattatgataatactattctaaatactgataactttatctcagaggtttaccattacttatctaataaatcttctaaagattggataattgcctatacatcagatcatggtcaatatgtaaaaggcgacacttataagcaagggacatttgatgaagataattatattgtgccattagttctatatagtccaaatgaagaaatacagaaactagtgttggacaattttgaatcatgtaagatttcatttcataatcagttatctagctttattattaatataatgggatataactattcagttagcacttgcgataagggggttgttaatggaaatattctcacaggtgatgctggatacctaaaaatagaatctaatggtaaacaagagtatgttcattaa

SEQ ID NO: 767 - protein, 487 aa, H. influenzae
KLFVCLFVCLFVFSKYRITRILVGALFAISIVVNNVHYAVYQSWIGPVNYSLAFKEINEITNAGLTMIDKFIYPLLFGLFEVAVFLSLSFIKRKVYKLSWIFDFIFYAVMMYVFVRAYTTKSHERFISPNTVYSRLKSNYLSLGYFIGRIVPYEIFSLSNIPLYHKSKPMKSGSPKIKNIILIMGESATSSHFSAFGYGRKTSPFLDSLKYKSGALVGKTYSGGKLTAISLPMFFNAIPYPNGIQQIAKGDTNLFNLAKEQGFQTYFYSAQARDDMHMINFLGGAWIDDIRFPDNEGYSLRDSMPDNKLLPAFKNINLDNGYHFVVLHHRGSHIPYGALLDEKEKVFGKNNATDNYDNTILNTDNFISEVYHYLSNKSSKDWIIAYTSDHGQYVKGDTYKQGTFDEDNYIVPLVLYSPNEEIQKLVLDNFESCKISFHNQLSSFIINIMGYNYSVSTCDKGVVNGNILTGDAGYLKIESNGKQEYVH

SEQ ID NO: 768 - DNA, 1494 bp, H. influenzae; identical to SEQ ID NO: 688

SEQ ID NO: 769 - protein, 497 aa, H. influenzae; identical to SEQ ID NO: 689

SEQ ID NO: 770 - DNA, 1758 bp, H. influenzae
atgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaaattacgtagtcttgaacgccaaaaatggctaaaaggcactggtatattcttaaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaaccaaataatgaaagtgcggtaaaaaatctcaatgattttattaaagcacaaaaaactgactcaccttggtttgcttatttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaataa

SEQ ID NO: 771 - protein, 585 aa, H. influenzae
MKWIKKGTFSGKQYRDDVSRKISWGHWFAFFNIIVAILIGARYAFIIDWPDTLAGKLYFFVSLLGHFSFNVFALYLLVVFPLSFIVKNHRTFRGLTVIFSTICTTLLLFDTAVFNRFNLHLSSVVWNLLVNPENGEMSRDWQIFFAPMPIILLAQMLFSRWSWEKLRSLERQKWLKGTGIFLTTTFIATHLIYAWADAYLYRPITMQRSNFPLSYPMTARSFLEKHGFLDGEEYTQKLAQEGRLDALKIDYPKKELTYAPITHKPNILLVTVSGLRHDAISNEKMPKLAKFATSSTEFTNHYSTGNSNNAGLIGLFYGLNANYTDSILSNHTQSVLIEKLRAENYQLGLFSATNFKDSIFRQALFREIKLSSNKTNKPNNESAVKNLNDFIKAQKTDSPWFAYLDLALDAKNPSDYDRTLQDIDSLLTKALESTPLENTLVIITSEHGLTFNEMNQKERENYFGRDEIQVPLLVYWKDLPVGKQNGLSNHADIFSALMQTVFRVENPLMDYSQGRNLFDLKGDDWVLASNFRWNVVIQPDGTQYHIDRKGNYKKFDKDYIEQSSDRPPLGIFLEAFQLQNFFFEK
